United States Patent 7,745,391 (HUMAN THROMBOSPONDIN POLYPEPTIDE) - sequence listing, part 175

SEQ ID NO: 436272 - DNA, 8046 bp, Homo sapiens
  misc_feature (1531)..(1531): n is a, c, g, or t
tgatggcggcggcgctggggcccccagaagtgatcgctcagctggagaacgcggctaaagttctgatggcaccaccttccatggtcaataatgaacaacgccagcatgcagagcacatattcttatcatttaggaaatcaaaatcaccatttgcagtttgcaagcatattttggaaactagtaaagtggactatgtcctctttcaagctgccacagccataatggaagcagttgtccgagagtggattctcttggaaaaaggtagcatcgagtctctgcgaacattccttttaacctatgtcttacaaaggcccaaccttcaaaagtatgttcgggaacagattctactagcagtagcagtaattgtaaaaagaggatcattagataaatcaattgactgcaaaagcatttttcatgaagtcagccagttgattagtagtggcaatcccactgtgcaaactctggcctgttctattctgactgcgctattgagtgaattttcaagttcaagtaaaactagcaacattggattgagcatggaattccatggtaactgcaaaagagtttttcaggaagaagaccttcgtcagatcttcatgttaactgttgaagttctgcaggagttcagcaggcgggaaaacctcaatgctcagatgtcttcagtatttcagcgttaccttgcactcgccaatcaagtcttgagctggaactttcttcctccaaatttgggcagacattatatagctatgtttgaatcctcgcaaaatgtgctgttgaagccaacagagtcctggcgggagactcttctggacagcagagttatggagcttttcttcacagtacatcgaaaaatcagagaagattcagatatggcacaagattctctgcagtgccttgcccagttagcttctcttcatggacccatcttcccagatgaaggatcacaagttgattatctagcacacttcattgagggattactgaatactatcaatggaattgaaatagaagattctgaagctgtggggatctccagcattatcagcaacctgataaccgtgttcccacgaaatgttttaactgccattccaagtgaacttttctcctcctttgttaactgcctcacacacctcacttgttcttttgggcgaagtgctgcattggaagaagtgcttgataaagatgacatggtatacatggaagcatatgataaattgttggagtcctggttaactttggttcaagatgacaaacatttccataaaggcttttttacccaacatgcagttcaagttttcaattcctatattcagtgccacctagctgctccagatggcacaagaaatttgactgccaatggtgtggcctctcgtgaggaggaagaaataagtgaacttcaagaggatgatcgagaccagttttctgatcaactggccagtgtaggaatgctaggaagaattgctgcagaacactgtatacctcttctgacaagtttattagaagaaagagtaacaagactccatggtcagtnacaacgacatcagcaacagttacttgcttcaccgggttcaagcactgttgacaacaaaatgcttgatgatctctatgaagatattcactggcttattttagttacaggctacctcttagctgatgatactcagggagagactccgctaatacctccagaaataatggaatattccattaagcattcatctgaagttgacattaatacaacacttcaaattttgggatctccaggagaaaaggcttcttccatcccagggtacaacagaacagattctgtgattaggctgttgtctgccattctcagagtttcagaagttgaatctcgagcaataagagcagatctcactcatctactaagtccccagatgggcaaagatattgtttggtttttaaaacgctgggcaaagacttatctcctggtggatgaaaaactgtatgatcagataagtctgccattcagtacagcgttcggagcagatacagagggttctcagtggataattggctacctcttacaaaaagtcatcagtaacctctcagtctggagtagtgagcaggaccttgcaaatgacactgtgcagctccttgtcactttggtggaaagaagagaaagggcaaacttagtaattcaatgtgagaactggtggaatttagctaagcagtttgcaagccgaagcccacctcttaatttcttgtcaagtcctgtgcagaggacattgatgaaggctctagtcttaggaggttttgcacatatggacacagaaaccaaacagcagtattggacagaggttcttcagccacttcagcagcgattcttaagagtgataaaccaagaaaacttccagcagatgtgtcagcaagaggaagtcaagcaggaaatcactgccacactagaggccctgtgtggcattgctgaggctacccagattgacaacgtagcaatcctgtttaattttttaatggacttccttaccaattgcattggattgatggaagtttacaagaataccccagagactgtcaatctcattatagaagtttttgttgaagttgcacataaacagatatgctatcttggagagtccaaagctatgaacttatatgaagcctgccttactttgttgcaagtgtattctaagaataatttagggcggcaaagaatagatgttacagcagaagaagagcaataccaagacctgcttctcattatggaacttcttactaacctgctgtcaaaagaattcatagatttcagtgatacagatgaagtgtttagaggacatgagccaggtcaagcagcaaacagatctgtgtcagcagcggatgttgtgttgtatggagtaaacctaattctgcccttgatgtcacaggatctcttgaagtttccaaccctttgtaatcagtactacaaattaatcacatttatctgtgagatttttcctgaaaaaataccacagcttcctgaggatctgtttaaaagtctgatgtactccctagaattaggaatgacatcaatgagttcggaggtttgccagctttgcctggaggccttgacaccgttagctgaacagtgtgcaaaagcacaagaaacagactcaccactttttctagcaacacggcactttcttaagctggtttttgatatgctggttttgcaaaagcacaacacagagatgaccactgcggctggcgaagctttctacacgttggtgtgtttgcaccaggctgaatattctgaactggtcgaaacattactatcaagtcagcaagacccagttatttaccagagattagcagatgccttcaacaagctcactgcaagcagcactcctcctacgctggatcggaagcagaagatggccttcttaaagagtttagaagaatttatggcaaatgttggtggtctcctttgtgtaaaataaacaacagaactttatgcttaatttagatcctttctgcaaagtgcactgaattgctgaaagttgacttgagtcttgtcctattcctcagttcatttggccattttggattttggagagcctgaaactttgatatgtatgtaatacagtgaaacaggagaggtcaacttggcatcagcttctgctgttaagtgttagccacaatctgtcatatatatgtcttttagattctgaatggtgatttaaaattttcaaaatgaaattccatatatgtgcaaacagatatgggcaccacgaaatacatatgcagtgccttttttccttttaacataggtggctagccaaagtttagaatttttgtcattaaatatgaaatggatatatgctaggcagtgtttctcaaaatctccatagatcgcctgcatcacttgaggagctggtgaaaaggcagattcttaggcccaactgtagaccttcagagtcagaatgtctggttgttgggcccaggagtcttcatgttaataagcttctccctttcgtcaccccaaaagttttgaatcaatgaaagagacattgaaaactcttaagaggttttgtgctttctagcttttcctccctttgatgattgggttttataattcagcaggaaggggaaacatcaccaggggtttgttggctttttcttagcttgctttcttgcttgcttgctttcttgcttttcttgctttctgtctctctctttcttttctctctctctctcacatcaacccagtgctgcaggttttgtgtaatacaagtcactaatcatactctgatgcctgaacttgaggaggaaaatacatgtatatttttgttccgtaaaaataaccttaggaactgtagccatttcattgccttaattttaagaggaaaatacaaaaacagctgatttgttttagtaagaaaccacgtcttgatgcttcagagttggtttagggtgttagctgctatgaacctgttgcccctttcgatcgtgtatttatgtaggtttatcagtgaaatgaaaggcttgtttccgtctagtctaactttttgagtgtgtttctatccagccacatagcccatatctactctaaatggcttgcttaagcaataattattttaaaggatgtgaatcactgattcacacagactattgcacgttggggcattaggggcaataattcttatccagacatgggagccagtgaatttaatttcagagattaaaaattcactttagatcctctagtttgatctcttaatcaggatttttatacagctgccaggctcccctaattcagtgtgccagcttacaatgtggaaatgaaagctaatttatacacagcaggcatatgaaactccactcattgcagtactttcacagcacagtgacaggtagaggactctggcacaggtgcactcatgaaactctgcttccaccatgttcctgacacctatctattaaaccattctgcaaatacggtttttctacctgattgcatatagcatatgtgtcattacatgtgatgctgtgcaaaactttgtataattctgtgttattaacagttaacaaaactggagcatctgaattacatccaacctgtgcatgtgatgttaggtagatgtgaatgcagggccttgggccataacttacatttctctcaatttgattagctttgagtcacaattaaggggaagcaaaaacatcttgaaaagactgctaggaaggaaattaatatcagtcatccagaagtacacgtttctgtattttaaaaaatactttgatgcatttatttttaggtgttttttttttccccttaaaaaacttgaagtgatatgcagcagtaatctatttgttttgcattgttcttggtgttttgtgtttcccagatccctcaagctttctcagctgttgcgaattatgtgtatctgtgtgtgtgctaagtacagtctctttaccaaagggcactgaaacacacaattgactggacaggtccacgcgccatgacaaaactataatcaagttattaaaactaaagaggagtgggaaaggaatgccttggtaagtaaaaaggcatctatatttaataacttttatccagatggcaacatatttgcaaaatttgcccagatcctattacaatactaaaaatagaaaatttcacctccatattcctgaggtgtaatttcattagactagttttagtttaaaaagaccttcttcagattggaccaaataatacttataagatcagcagaatgttgaatattagctcactggggtggggagaagccactaccattttttaggtgatggggatgccactgagttgcaacggctagaccttttcagggtggttgtgtccatgtttgcctgattggatgcttattcactttgtgttttcttttgttttattttgtccaattttgtctttagctgtgtttattaacttctccggtcttgttttgttttaatgctcttggcccagtgggtgtcaagaacactggcttaattcaagtcagttgattttttttctattaaaactgttgttaaaatattttttaaaacaaaaacattatttgtgccctcttttatatatgtcaaagggacactgtcaagtatttcatttttagatttttgttttataaaatttctgttgttcatatagtatcctttaacctctagttttccatacatcctttgtttgtttctcattttattttccttgacccatttatttcccaaggcacaatcactaaagactttgtactttcacagtctgttaatgtggtagcacctgtaactgtgttcttgttctgttaaaaggattgatttgcttttatagtccttgtgctggatgagtggctgcctcagtagcaaaactacctgacagtatttgacagtgtcctttccagcaccattatttgggtctttcagggtggccatctctgttagaagacagtagcatgttaacatcactgcattgagtttttgtctggtgtaaagtatgacttttaatgtaaacaaactgcaggtttttttcaaactaattttaagaatttagtcttatttcgttgtaaactgtgtatctaattatattacattactctgttcagatgggatggttactaccacttgtccatgattttcatttgaaaagcaagtatctatatcatttccccccagtcagcattatttaacactccccttaactgtctttgaactttctcttttaacaaaaatgtcaagtctttatagttgtaatatcaccatgtttcccatttctgttaatacttctatgaacccctaaagtattgaagggaactagctgtcagtttcaaggattacaagtttgagtctcctagtattcaacatcattctgaaccctgaaataatatttttctctgttaaacaatttttatctgtttgccacctctgttgttagaggtggttgtcaattgaccttactaagttagctgtctttgatgaggaattattgttattggttcctgaataaaacattaaccttttaagtcagaaggaacctcggtacttcttaaggtttgtttgtgttttctaaaaccagagaataaggaactgatttggctatgaggtttaacattataattttctgtaagctttcccacaaaaaaacattgttgatttgaggatataataatgttttaatctttttaaaatataagtggttattctctgacttggtaactatgttctgaaaacactgcatttaagaatttttaaaaattggttttctaaaattaaaatgtccaaattaggcatattgctgagctcaaattgatgtgaaatgccatggttccagttgaattttaagcatattttcatttagatataaaatatatgaagtatgctttgttgattatagtgagaacccatgacatagttaaccaaagaatatgtttggttcaaataaaaatagaagcttaatactgggcattcatactttttaaagagaatgaatgaagaaatcggtttcctgctgtagttctctatgggtaagtcttagtaaagacgagaatgctgaagtcggccgtggcgattccctcctaggaactgggaggtgtggcttgcccattacccgcttgaagctcacatctttaccctcctctcccactgtggtttgatcttcacctattcccaggccctcccagcaattggagaggtgtctttttttttggttttggttttttttctccccgtctgcattcttaggcctcttagctattaggaactgtcagatacatactagtagctaattttcctagcctgaaattatatactgcatctgcactatgtacctactagggatctgacctcaagtgttttctgagcccaggcttcctggtgtggtgtcttttaccacataaaattattacaaattgcaaatgttggtattgtgatttgattatctgtacaaagaaagaagctctatgcagtgagtttgtggtttaatggtcacaaaaatgttagcactgctaccactcagcacgtgtaaaattttttaaatttataaatattaaaattttaaactta

SEQ ID NO: 436273 - DNA, 6936 bp, Homo sapiens
  misc_feature (421)..(421): n is a, c, g, or t
caggctaggtagcgaggctgggtggttagtctttgggcgaagtgctgcattggtaagaagtgcttgataaagatgacatggtatacatggaagcatatgataaattgttggagtcctggttaactttggttcaagatgacaaacatttccataaaggcttttttacccaacatgcagttcaagttttcaattcctatattcagtgccacctagctgctccagatggcacaagaaatttgactgccaatggtgtggcctctcgtgaggaggaagaaataagtgaacttcaagaggatgatcgagaccagttttctgatcaactggccagtgtaggaatgctaggaagaattgctgcagaacactgtatacctcttctgacaagtttattagaagaaagagtaacaagactccatggtcagtnacaacgacatcagcaacagttacttgcttcaccgggttcaagcactgttgacaacaaaatgcttgatgatctctatgaagatattcactggcttattttagttacaggctacctcttagctgatgatactcagggagagactccgctaatacctccagaaataatggaatattccattaagcattcatctgaagttgacattaatacaacacttcaaattttgggatctccaggagaaaaggcttcttccatcccagggtacaacagaacagattctgtgattaggctgttgtctgccattctcagagtttcagaagttgaatctcgagcaataagagcagatctcactcatctactaagtccccagatgggcaaagatattgtttggtttttaaaacgctgggcaaagacttatctcctggtggatgaaaaactgtatgatcagataagtctgccattcagtacagcgttcggagcagatacagagggttctcagtggataattggctacctcttacaaaaagtcatcagtaacctctcagtctggagtagtgagcaggaccttgcaaatgacactgtgcagctccttgtcactttggtggaaagaagagaaagggcaaacttagtaattcaatgtgagaactggtggaatttagctaagcagtttgcaagccgaagcccacctcttaatttcttgtcaagtcctgtgcagaggacattgatgaaggctctagtcttaggaggttttgcacatatggacacagaaaccaaacagcagtattggacagaggttcttcagccacttcagcagcgattcttaagagtgataaaccaagaaaacttccagcagatgtgtcagcaagaggaagtcaagcaggaaatcactgccacactagaggccctgtgtggcattgctgaggctacccagattgacaacgtagcaatcctgtttaattttttaatggacttccttaccaattgcattggattgatggaagtttacaagaataccccagagactgtcaatctcattatagaagtttttgttgaagttgcacataaacagatatgctatcttggagagtccaaagctatgaacttatatgaagcctgccttactttgttgcaagtgtattctaagaataatttagggcggcaaagaatagatgttacagcagaagaagagcaataccaagacctgcttctcattatggaacttcttactaacctgctgtcaaaagaattcatagatttcagtgatacagatgaagtgtttagaggacatgagccaggtcaagcagcaaacagatctgtgtcagcagcggatgttgtgttgtatggagtaaacctaattctgcccttgatgtcacaggatctcttgaagtttccaaccctttgtaatcagtactacaaattaatcacatttatctgtgagatttttcctgaaaaaataccacagcttcctgaggatctgtttaaaagtctgatgtactccctagaattaggaatgacatcaatgagttcggaggtttgccagctttgcctggaggccttgacaccgttagctgaacagtgtgcaaaagcacaagaaacagactcaccactttttctagcaacacggcactttcttaagctggtttttgatatgctggttttgcaaaagcacaacacagagatgaccactgcggctggcgaagctttctacacgttggtgtgtttgcaccaggctgaatattctgaactggtcgaaacattactatcaagtcagcaagacccagttatttaccagagattagcagatgccttcaacaagctcactgcaagcagcactcctcctacgctggatcggaagcagaagatggccttcttaaagagtttagaagaatttatggcaaatgttggtggtctcctttgtgtaaaataaacaacagaactttatgcttaatttagatcctttctgcaaagtgcactgaattgctgaaagttgacttgagtcttgtcctattcctcagttcatttggccattttggattttggagagcctgaaactttgatatgtatgtaatacagtgaaacaggagaggtcaacttggcatcagcttctgctgttaagtgttagccacaatctgtcatatatatgtcttttagattctgaatggtgatttaaaattttcaaaatgaaattccatatatgtgcaaacagatatgggcaccacgaaatacatatgcagtgccttttttccttttaacataggtggctagccaaagtttagaatttttgtcattaaatatgaaatggatatatgctaggcagtgtttctcaaaatctccatagatcgcctgcatcacttgaggagctggtgaaaaggcagattcttaggcccaactgtagaccttcagagtcagaatgtctggttgttgggcccaggagtcttcatgttaataagcttctccctttcgtcaccccaaaagttttgaatcaatgaaagagacattgaaaactcttaagaggttttgtgctttctagcttttcctccctttgatgattgggttttataattcagcaggaaggggaaacatcaccaggggtttgttggctttttcttagcttgctttcttgcttgcttgctttcttgcttttcttgctttctgtctctctctttcttttctctctctctctcacatcaacccagtgctgcaggttttgtgtaatacaagtcactaatcatactctgatgcctgaacttgaggaggaaaatacatgtatatttttgttccgtaaaaataaccttaggaactgtagccatttcattgccttaattttaagaggaaaatacaaaaacagctgatttgttttagtaagaaaccacgtcttgatgcttcagagttggtttagggtgttagctgctatgaacctgttgcccctttcgatcgtgtatttatgtaggtttatcagtgaaatgaaaggcttgtttccgtctagtctaactttttgagtgtgtttctatccagccacatagcccatatctactctaaatggcttgcttaagcaataattattttaaaggatgtgaatcactgattcacacagactattgcacgttggggcattaggggcaataattcttatccagacatgggagccagtgaatttaatttcagagattaaaaattcactttagatcctctagtttgatctcttaatcaggatttttatacagctgccaggctcccctaattcagtgtgccagcttacaatgtggaaatgaaagctaatttatacacagcaggcatatgaaactccactcattgcagtactttcacagcacagtgacaggtagaggactctggcacaggtgcactcatgaaactctgcttccaccatgttcctgacacctatctattaaaccattctgcaaatacggtttttctacctgattgcatatagcatatgtgtcattacatgtgatgctgtgcaaaactttgtataattctgtgttattaacagttaacaaaactggagcatctgaattacatccaacctgtgcatgtgatgttaggtagatgtgaatgcagggccttgggccataacttacatttctctcaatttgattagctttgagtcacaattaaggggaagcaaaaacatcttgaaaagactgctaggaaggaaattaatatcagtcatccagaagtacacgtttctgtattttaaaaaatactttgatgcatttatttttaggtgttttttttttccccttaaaaaacttgaagtgatatgcagcagtaatctatttgttttgcattgttcttggtgttttgtgtttcccagatccctcaagctttctcagctgttgcgaattatgtgtatctgtgtgtgtgctaagtacagtctctttaccaaagggcactgaaacacacaattgactggacaggtccacgcgccatgacaaaactataatcaagttattaaaactaaagaggagtgggaaaggaatgccttggtaagtaaaaaggcatctatatttaataacttttatccagatggcaacatatttgcaaaatttgcccagatcctattacaatactaaaaatagaaaatttcacctccatattcctgaggtgtaatttcattagactagttttagtttaaaaagaccttcttcagattggaccaaataatacttataagatcagcagaatgttgaatattagctcactggggtggggagaagccactaccattttttaggtgatggggatgccactgagttgcaacggctagaccttttcagggtggttgtgtccatgtttgcctgattggatgcttattcactttgtgttttcttttgttttattttgtccaattttgtctttagctgtgtttattaacttctccggtcttgttttgttttaatgctcttggcccagtgggtgtcaagaacactggcttaattcaagtcagttgattttttttctattaaaactgttgttaaaatattttttaaaacaaaaacattatttgtgccctcttttatatatgtcaaagggacactgtcaagtatttcatttttagatttttgttttataaaatttctgttgttcatatagtatcctttaacctctagttttccatacatcctttgtttgtttctcattttattttccttgacccatttatttcccaaggcacaatcactaaagactttgtactttcacagtctgttaatgtggtagcacctgtaactgtgttcttgttctgttaaaaggattgatttgcttttatagtccttgtgctggatgagtggctgcctcagtagcaaaactacctgacagtatttgacagtgtcctttccagcaccattatttgggtctttcagggtggccatctctgttagaagacagtagcatgttaacatcactgcattgagtttttgtctggtgtaaagtatgacttttaatgtaaacaaactgcaggtttttttcaaactaattttaagaatttagtcttatttcgttgtaaactgtgtatctaattatattacattactctgttcagatgggatggttactaccacttgtccatgattttcatttgaaaagcaagtatctatatcatttccccccagtcagcattatttaacactccccttaactgtctttgaactttctcttttaacaaaaatgtcaagtctttatagttgtaatatcaccatgtttcccatttctgttaatacttctatgaacccctaaagtattgaagggaactagctgtcagtttcaaggattacaagtttgagtctcctagtattcaacatcattctgaaccctgaaataatatttttctctgttaaacaatttttatctgtttgccacctctgttgttagaggtggttgtcaattgaccttactaagttagctgtctttgatgaggaattattgttattggttcctgaataaaacattaaccttttaagtcagaaggaacctcggtacttcttaaggtttgtttgtgttttctaaaaccagagaataaggaactgatttggctatgaggtttaacattataattttctgtaagctttcccacaaaaaaacattgttgatttgaggatataataatgttttaatctttttaaaatataagtggttattctctgacttggtaactatgttctgaaaacactgcatttaagaatttttaaaaattggttttctaaaattaaaatgtccaaattaggcatattgctgagctcaaattgatgtgaaatgccatggttccagttgaattttaagcatattttcatttagatataaaatatatgaagtatgctttgttgattatagtgagaacccatgacatagttaaccaaagaatatgtttggttcaaataaaaatagaagcttaatactgggcattcatactttttaaagagaatgaatgaagaaatcggtttcctgctgtagttctctatgggtaagtcttagtaaagacgagaatgctgaagtcggccgtggcgattccctcctaggaactgggaggtgtggcttgcccattacccgcttgaagctcacatctttaccctcctctcccactgtggtttgatcttcacctattcccaggccctcccagcaattggagaggtgtctttttttttggttttggttttttttctccccgtctgcattcttaggcctcttagctattaggaactgtcagatacatactagtagctaattttcctagcctgaaattatatactgcatctgcactatgtacctactagggatctgacctcaagtgttttctgagcccaggcttcctggtgtggtgtcttttaccacataaaattattacaaattgcaaatgttggtattgtgatttgattatctgtacaaagaaagaagctctatgcagtgagtttgtggtttaatggtcacaaaaatgttagcactgctaccactcagcacgtgtaaaattttttaaatttataaatattaaaattttaaactta

SEQ ID NO: 436274 - DNA, 1246 bp, Homo sapiens
tgatggcggcggcgctggggcccccagaagtgatcgctcagctggagaacgcggctaaagttctgatggcaccaccttccatggtcaataatgaacaacgccagcatgcagagcacatattcttatcatttaggaaatcaaaatcaccatttgcagtttgcaagcatattttggaaactagtaaagtggactatgtcctctttcaagctgccacagccataatggaagcagttgtccgagagtggattctcttggaaaaaggtagcatcgagtctctgcgaacattccttttaacctatgtcttacaaaggcccaaccttcaaaagtatgttcgggaacagattctactagcagtagcagtaattgtaaaaagaggatcattagataaatcaattgactgcaaaagcatttttcatgaagtcagccagttgattagtagtggcaatcccactgtgcaaactctggcctgttctattctgactgcgctattgagtgaattttcaagttcaagtaaaactagcaacattggattgagcatggaattccatggtaactgcaaaagagtttttcaggaagaagaccttcgtcagatcttcatgttaactgttgaagttctgcaggagttcagcaggcgggaaaacctcaatgctcagatgtcttcagtatttcagcgttaccttgcactcgccaatcaagtcttgagctggaactttcttcctccaaattctaactggattatagagtaagtaatgggatacagaagctttcacctaaattggatttccagtaaagccaacctttactatttggaggcaaggcttgggaaaacattcaggtaaggtcactcatgtatttcaaaggatttgtggttgcttggactgtgttgtctataagactggggttgttggttctgtgctgtgccaggagaagtagcagtttttgttgttagaaaatttaataatgaaagggattaaatatttaagaaagaaaatggtcttgctgtagctcctgaaactttgttttactgatgaagtagggtaaaaaatagtatggaaagatgaagggagtaaagcatttattacttatgtgaaatgcccattgttgctacaagatctttctatattgtaaagtaattataagaataggcaaaggaaattttcagattgtccatatttgcttgaagataatgtgtagctactgtatgccttatttaattatttttttgagtgtcattcacaatcacaaa

SEQ ID NO: 436275 - DNA, 1773 bp, Homo sapiens
cggaagcgagaccgtccatccagaggaaggcaagtttttggctcgggcggctgagaagaccgcgcggggctggagacaggtagcagtacgggggcggggcttcatgccggatgtgatagtctgcagtcgtttcggttggcagcctggcgggtgggagatgcggcggccacctgctgcaaagaaccgaagggaaggttagaagtacgaaggcagtttggagctggggctaagcagctgtcgcacggtcagatcatgggctccaccaagcactggggcgaatggctcctgaacttgaaggtggctccagccggcgtctttggtgtggcctttctagccagagtcgccctggttttctatggcgtcttccaggaccggaccctgcacgtgaggtatacggacatcgactaccaggtcttcaccgacgccgcgcgcttcgtcacggaggggcgctcgccttacctgagagccacgtaccgttacaccccgctgctgggttggctcctcactcccaacatctacctcagcgagctctttggaaagtttctcttcatcagctgcgacctcctcaccgctttcctcttataccgcctgctgctgctgaaggggctggggcgccgccaggcttgtggctactgtgtcttttggcttcttaaccccctgcctatggcagtatccagccgcggtaatgcggactctattgtcgcctccctggtcctgatggtcctctacttgataaagaaaagactcgtcgcgtgtgcagctgtattctatggtttcgcggtgcatatgaagatatatccagtgacttacatccttcccataaccctccacctgcttccagatcgcgacaatgacaaaagcctccgtcaattccggtacactttccaggcttgtttgtacgagctcctgaaaaggctgtgtaatcgggctgtgctgctgtttgtagcagttgctggactcacgttttttgccctgagctttggtttttactatgagtacggctgggaatttttggaacacacctacttttatcacctgactaggcgggatatccgtcacaacttttctccgtacttctacatgctgtatttgactgcagagagcaagtggagtttttccctgggaattgctgcattcctgccacagctcatcttgctttcagctgtgtctttcgcctattacagagacctcgttttttgttgttttcttcatacgtccatttttgtgacttttaacaaagtctgcacctcccagtactttctttggtacctctgcttactgcctcttgtgatgccactagtcagaatgccttggaaaagagctgtagttctcctaatgttatggtttatagggcaggccatgtggctggctcctgcctatgttctagagtttcaaggaaagaacacctttctgtttatttggttagctggtttgttctttcttcttatcaattgttccatcctgattcaaattatttcccattacaaagaagaacccctgacagagagaatcaaatatgactagtgtatgttccacaccctctgctactgtgttacattctgattgtcttgtatggaccagaagagagctttgggacattttttctgaacattctaagcattctagtgaaagttcccatgttccaacagaacttaaaagcaatgtttgccttatatataaaagggacacaataattgaggtccaccttctaggaaatcctaggactcgtttatttgggacatggtgggaataaaggtcacatattggaaaatg

SEQ ID NO: 436276 - DNA, 760 bp, Homo sapiens
gttcctaaatattcctggataaattctcttgataggcccattggaaaggctaatactcccacccagctggagtgcagtggtataaacatggctcactgcagccgaactcccaggctcaggtgatccttcctcctcagcctcccaagtagctgggaccacaggtatttgccaccatgcctggctaatctttattttttgtagagacgaggtcttgctatgttgcaagagggagatcacttaagtgatcttccctcattggcttcccaaagtgttgggattccaggcgtgagccactgcaccccgcctgacctaactattttaaacactactcatattgccatcatctaaattcaacaacaatttgccatatttgctttatgtatatgtataattatatatttataaaattttttgaaccatgtgaagttgcaaacatcattgaacttcaccactaaatatatcagcatgcatctcctaaaaatcaggtattttcttacaaaaccataattctgctatctattatgatttaacattctgtcattttcaaatttcttcaggtgttttttgttacatcttaaagaacagacattcttggatctcaaagattccgaggaaggaaagaacatggtggataatccataattaagaagtttgaatcttttcctagtcttaaaaacaaagtgagaactaaaggggtttaccttccatcaaagttgaacaaattaattcttttgtgtgtcatactttctgtctctctccc

SEQ ID NO: 436277 - DNA, 2769 bp, Homo sapiens
cggaagcgagaccgtccatccagaggaaggcaagtttttggctcgggcggctgagaagaccgcgcggggctggagacaggtagcagtacgggggcggggcttcatgccggatgtgatagtctgcagtcgtttcggttggcagcctggcgggtgggagatgcggcggccacctgctgcaaagaaccgaagggaaggttagaagtacgaaggcagtttggagctggggctaagcagctgtcgcacggtcagatcatgggctccaccaagcactggggcgaatggctcctgaacttgaaggtggctccagccggcgtctttggtgtggcctttctagccagagtcgccctggttttctatggcgtcttccaggaccggaccctgcacgtgaggtatacggacatcgactaccaggtcttcaccgacgccgcgcgcttcgtcacggaggggcgctcgccttacctgagagccacgtaccgttacaccccgctgctgggttggctcctcactcccaacatctacctcagcgagctctttggaaagtttctcttcatcagctgcgacctcctcaccgctttcctcttataccgcctgctgctgctgaaggggctggggcgccgccaggcttgtggctactgtgtcttttggcttcttaaccccctgcctatggcagtatccagccgcggtaatgcggactctattgtcgcctccctggtcctgatggtcctctacttgataaagaaaagactcgtcgcgtgtgcagctgtattctatggtttcgcggtgcatatgaagatatatccagtgacttacatccttcccataaccctccacctgcttccagatcgcgacaatgacaaaagcctccgtcaattccggtacactttccaggcttgtttgtacgagctcctgaaaaggctgtgtaatcgggctgtgctgctgtttgtagcagttgctggactcacgttttttgccctgagctttggtttttactatgagtacggctgggaatttttggaacacacctacttttatcacctgactaggcgggatatccgtcacaacttttctccgtacttctacatgctgtatttgactgcagagagcaagtggagtttttccctgggaattgctgcattcctgccacagctcatcttgctttcagctgtgtctttcgcctattacagagacctcgttttttgttgttttcttcatacgtccatttttgtgacttttaacaaagtctgcacctcccagtactttctttggtacctctgcttactgcctcttgtgatgccactagtcagaatgccttggaaaagagctgtagttctcctaatgttatggtttatagggcaggccatgtggctggctcctgcctatgttctagagtttcaaggaaagaacacctttctgtttatttggttagctggtttgttctttcttcttatcaattgttccatcctgattcaaattatttcccattacaaagaagaacccctgacagagagaatcaaatatgactagtgtatgttccacaccctctgctactgtgttacattctgattgtcttgtatggaccagaagagagctttgggacattttttctgaacattctaagcattctagtgaaagttcccatgttccaacagaacttaaaagcaatgtttgccttatatataaaagggacacaataattgaggtccaccttctaggaaatcctaggactcgtttatttgggacatggtgggaataaaggtcacatattggaaaatggaaaggctgatgaaactatcagatactaaaacattcttaaaatagaggaatatagttagagacatcaggtttaagccagtatttgttcctgttttacaatgcttctgtcttaagctgtgtcttaacttttaacacccatcttttctttctaaagctttcctgacagctgtgaaaatccaaaaaatattcttaaactgtgtatggtggcccttgcctgtagtctcagcactttgggaggctgaggtgggagggtcgcttgagttcaggagttctagacccacctggggcaagatggtgagacctagtctcaaaaaaaaaaaaaaaaattagccaggtgttgtggtgcacccctgtagtcatagctgcatgggaggctgaggtgggagaattgcttgagcccagagcaagaccctgtctcaaaaaaaaaaaaaaaaaaaaaaggaaaggacaactttttagatagaaaagtattaaataatactaagatgcttagtagtattattttagagagttttaaacttctatattaaatgtggggtcttacaagataatccaaagatgttgggattccaggcgtgagccactgcaccccgcctgacctaactattttaaacactactcatattgccatcatctaaattcaacaacaatttgccatatttgctttatgtatatgtataattatatatttataaaattttttgaaccatgtgaagttgcaaacatcattgaacttcaccactaaatatatcagcatgcatctcctaaaaatcaggtattttcttaccttcaggtgttttttgttacatcttaaagaacagacattcttggatctcaaagattccgaggaaggaaagaacatggtggataatccataattaagaagtttgaatcttttcctagtcttaaaaacaaagtgagaactaaaggggtttaccttccatcaaagttgaacaaattaattcttttgtgtgtcatactttctgtctctctccc

SEQ ID NO: 436278 - DNA, 1949 bp, Homo sapiens
ttgagacaaggctttactctgtcgcttaggctggagtgcagggatgtgatcactgaagccttgacctggtctcaagcaatcttccctcccagctactcctcgggaggctgaggcaggagaatggcgtgaactccggaggtggagcctgtagtgagccgagatggcaccactgcgctccagcctgggcgacagagcaagactccatatcaaaaaaaaaaaaaaaaagataatccaaagaatttaaattgtaatcatgtttcatgtatttgttttattacttacttttatagcacttagtcccagtggtattagactgctatttggtttcatacaaaaaggattaaatttaaattcattcatgtttagacttgagttattacatttttaaaactatcatcttgcctttaatgtttgtggtcctacacaaactattagtacatttcagtatcctcttacccctttgtttttaagtttttgattgctaaagcaagacttttttcttctagaatttaagtcaaccaagtgttatctatgttgtaaaaatggataatagtagattttaggtgataaaacaacttgttagtaagacatttcctagcttaaaaaaaaaaatcaaaaattccatgatagaaatgcagacctgtgagggaaactcctgaaaagcataagaagcatcccagagagccatgggttttctagaccagagaatttagagggagattgtggaactgaggcttaggtggtcagatcgtttcccttatcactgtaatatttctgggggaaaaatgctttctgagttgtttaaacaagcatccttacattttttttttaattaaacagcctgtcttaggcttgggattccctaatactacagtagcagtatatgaatatgattttgtgattgtgttttttaaaagataagtaatttgatgaactgttcttttgcagtcagaaaacactcacaaaaagacaaaaaaagttccacagtattatatttcatgtcagttcaggcctaaaatcctttgcaaataagatgtttataggctggtcacaattaacaatgttattattggcagcacttcttggatggataccttttgggacctttcattagaaagagggaaagaatggggtggttttgtatgggctcctgtttggggtaaaaatagcagagtcagttgctgaggacaatgaccttccttataacatttagtttcatacccatattaggtcttgtcttgaggaccctttatatgtgcttgtttactagtggccttccagccatagcattcttacctttttttcctattctaagaattaaaaaaaaaaattatagagccagcaagggaggaggcaggaaacagaaatcgaatttcatcattccagtatagttgtccctttttttgtatttctgacttggttttataattatatttacttactaattattgttttttaacattctttattgtggcttactcttcatacttagaattgaaattgttggacatcacatgtatattcacattataaatacatcattcttccactgttagacctttagattgcttccagtttttaatattctaaataagactttcaacattttctgtgttttagctcattctcttaggacattcttagaagttagaaacatttctgctgggatcgttggagggaacttcaaactttggaatctttcctgcaagaaattctttaccaaagaaaggcaggtgtttcttaaagggatgcaaaagatattttgcactttgtatgttccaaaacatttagtaagttaactaaaaaaatgagttaatttggtttcttgggggattttaattttttaatttgttttctggttatgtaaaaaaaatgttttttttttgcttcttatcacaatccttttgtttcctttttaatcctttaataacaccttcaaattttataag

SEQ ID NO: 436279 - DNA, 1237 bp, Homo sapiens
gttcctaaatattcctggataaattctcttgataggcccattggaaaggctaatactcccacccagtgctttgttccttcctggcaaaagaattcctaaaaccactgattttagttactgacttctcaccatctggactcttacaagatgtttcagaagttgtgtagaacttgtctttcagttgacttgtggctgaatttactgttacttctctaatatcagttgttttctgcattaccaccctctcccctaaccatctgtactatgaatggaaaaggaaaaagatggaaaaattatacctaggattgtccctaaatgcaacctcttggttccccccacccctcatgttttattataaacgattttaagagctgggcatggtggttcatgcctataatcccaatgctttgggaagctgaggcaggaggatcacttgaggacaggagtttgagaccagcctggacaacatagtgagacccccatctgtacaaaaaaaaaagtgctacttgggaagctgaagtgggaggaccacttgagcccaggctggagtgcagtggtataaacatggctcactgcagccgaactcccaggctcaggtgatccttcctcctcagcctcccaagtagctgggaccacaggtatttgccaccatgcctggctaatctttattttttgtagagacgaggtcttgctatgttgcaagagggagatcacttaagtgatcttccctcattggcttcccaaagtgttgggattccaggcgtgagccactgcaccccgcctgacctaactattttaaacactactcatattgccatcatctaaattcaacaacaatttgccatatttgctttatgtatatgtataattatatatttataaaattttttgaaccatgtgaagttgcaaacatcattgaacttcaccactaaatatatcagcatgcatctcctaaaaatcaggtattttcttacaaaaccataattctgctatctattatgatttaacattctgtcattttcaaatttcttcaggtgttttttgttacatcttaaagaacagacattcttggatctcaaagattccgaggaaggaaagaacatggtggataatccataattaagaagtttgaatcttttcctagtcttaaaaacaaagtgagaactaaaggggtttaccttccatcaaagttgaacaaattaattcttttgtgtgtcatactttctgtctctctccc

SEQ ID NO: 436280 - DNA, 356 bp, Homo sapiens
actttttagatagaaaagtattaaataatactaagatgcttagtagtattattttagagagttttaaacttctatattaaatgtggggtcttacaagataatccaaagactttgggaggccaaggcgggcagatcacgaggtcaggagattgagaccatcctggctaacacggtgaaacccctctctactaaaaatacaaaaaattagccgggcgtggtgggtgcctgtagtcccagctactcctcgggaggctgaggcaggagaatggcgtgaactccggaggtggagcctgtagtgagccgagatggcaccactgcgctccagcctgggcgacagagcaagactccatatcaaa

SEQ ID NO: 436281 - DNA, 603 bp, Homo sapiens
  misc_feature (588)..(588): n is a, c, g, or t
cggaagcgagaccgtccatccagaggaaggcaagtttttggctcgggcggctgagaagaccgcgcggggctggagacaggtagcagtacgggggcggggcttcatgccggatgtgatagtctgcagtcgtttcggttggcagcctggcgggtgggagatgcggcggccacctgctgcaaagaaccgaagggaaggttagaagtacgaaggcagtttggagctggggctaagcagctgtcgcacggtcagatcatgggctccaccaagcactggggcgaatggctcctgaacttgaaggtggctccagccggcgtctttggtgtggcctttctagccagagtcgccctggttttctatggcgtcttccaggaccggaccctgcacgtgaggtatacggacatcgactaccaggtcttcaccgacgccgcgcgcttcgtcacggaggggcgctcgccttacctgagagccacgtaccgttacaccccgctgctgggttggctcctcactcccaacatctacctcagcgagctctttggaaagtttctcttcatcagctgcgacctcctcccaacacccaactccgaatcntgcggtaccgagctc

SEQ ID NO: 436282 - DNA, 2823 bp, Homo sapiens
cggaagcgagaccgtccatccagaggaaggcaagtttttggctcgggcggctgagaagaccgcgcggggctggagacaggtagcagtacgggggcggggcttcatgccggatgtgatagtctgcagtcgtttcggttggcagcctggcgggtgggagatgcggcggccacctgctgcaaagaaccgaagggaaggttagaagtacgaaggcagtttggagctggggctaagcagctgtcgcacggtcagatcatgggctccaccaagcactggggcgaatggctcctgaacttgaaggtggctccagccggcgtctttggtgtggcctttctagccagagtcgccctggttttctatggcgtcttccaggaccggaccctgcacgtgaggtatacggacatcgactaccaggtcttcaccgacgccgcgcgcttcgtcacggaggggcgctcgccttacctgagagccacgtaccgttacaccccgctgctgggttggctcctcactcccaacatctacctcagcgagctctttggaaagtttctcttcatcagctgcgacctcctcaccgctttcctcttataccgcctgctgctgctgaaggggctggggcgccgccaggcttgtggctactgtgtcttttggcttcttaaccccctgcctatggcagtatccagccgcggtaatgcggactctattgtcgcctccctggtcctgatggtcctctacttgataaagaaaagactcgtcgcgtgtgcagctgtattctatggtttcgcggtgcatatgaagatatatccagtgacttacatccttcccataaccctccacctgcttccagatcgcgacaatgacaaaagcctccgtcaattccggtacactttccaggcttgtttgtacgagctcctgaaaaggctgtgtaatcgggctgtgctgctgtttgtagcagttgctggactcacgttttttgccctgagctttggtttttactatgagtacggctgggaatttttggaacacacctacttttatcacctgactaggcgggatatccgtcacaacttttctccgtacttctacatgctgtatttgactgcagagagcaagtggagtttttccctgggaattgctgcattcctgccacagctcatcttgctttcagctgtgtctttcgcctattacagagacctcgttttttgttgttttcttcatacgtccatttttgtgacttttaacaaagtctgcacctcccagtactttctttggtacctctgcttactgcctcttgtgatgccactagtcagaatgccttggaaaagagctgtagttctcctaatgttatggtttatagggcaggccatgtggctggctcctgcctatgttctagagtttcaaggaaagaacacctttctgtttatttggttagctggtttgttctttcttcttatcaattgttccatcctgattcaaattatttcccattacaaagaagaacccctgacagagagaatcaaatatgactagtgtatgttccacaccctctgctactgtgttacattctgattgtcttgtatggaccagaagagagctttgggacattttttctgaacattctaagcattctagtgaaagttcccatgttccaacagaacttaaaagcaatgtttgccttatatataaaagggacacaataattgaggtccaccttctaggaaatcctaggactcgtttatttgggacatggtgggaataaaggtcacatattggaaaatggaaaggctgatgaaactatcagatactaaaacattcttaaaatagaggaatatagttagagacatcaggtttaagccagtatttgttcctgttttacaatgcttctgtcttaagctgtgtcttaacttttaacacccatcttttctttctaaagctttcctgacagctgtgaaaatccaaaaaatattcttaaactgtgtatggtggcccttgcctgtagtctcagcactttgggaggctgaggtgggagggtcgcttgagttcaggagttctagacccacctggggcaagatggtgagacctagtctcaaaaaaaaaaaaaaaaattagccaggtgttgtggtgcacccctgtagtcatagctgcatgggaggctgaggtgggagaattgcttgagcccagagcaagaccctgtctcaaaaaaaaaaaaaaaaaaaaaaggaaaggacaactttttagatagaaaagtattaaataatactaagatgcttagtagtattattttagagagttttaaacttctatattaaatgtggggtcttacaagataatccaaagatgttgggattccaggcgtgagccactgcaccccgcctgacctaactattttaaacactactcatattgccatcatctaaattcaacaacaatttgccatatttgctttatgtatatgtataattatatatttataaaattttttgaaccatgtgaagttgcaaacatcattgaacttcaccactaaatatatcagcatgcatctcctaaaaatcaggtattttcttacaaaaccataattctgctatctattatgatttaacattctgtcattttcaaatttcttcaggtgttttttgttacatcttaaagaacagacattcttggatctcaaagattccgaggaaggaaagaacatggtggataatccataattaagaagtttgaatcttttcctagtcttaaaaacaaagtgagaactaaaggggtttaccttccatcaaagttgaacaaattaattcttttgtgtgtcatactttctgtctctctccc

SEQ ID NO: 436283 - DNA, 1857 bp, Homo sapiens
tttatctacatgtgacagttttctatcattgggttttttaaaaaatctgtgtattcaactagaacttgagctccacggaggcaggaacttttgttttgtttttcttcactgctcttttcctcgcacctgtctgaagcagtgattttagccagaatctagatttcctgattctggtccagtgctctttccatggttctgtgtgacctcatacatcaaccttatttcacaaacgaggtttttaagttccttgagcacagtcgattgtgttttttactgcttctgctccgtccctgcataagacaggactgtgtcatgtacccagtgatggactcctggtaaataccatggcttgactaaatgacctccagtgctccctgtggtcttcaccaacacgcatcagacgacaggctcagccacgggatacttcgctttctgtaggagtaagagacaagttgctatcactgaacagatacacagtggcatttggaaactgcatgcagtttgaaaaaatcgtgatacagcaggagtctagttttcaataaatagcttattcatattctggattttgaacagttcatgtaactgtaactttggggtagtggataatgagactgaaattaatggttcctctgctggtttccgtctgttttttttttttttctcccaggaggttggtatttctgcacttaaccacctgatgtttttagggggagtatatcccagataaattctgttgtaagtcaaagagcatccatgattggcttggctctttcttaagcaactactaagatgctcctacatttgggtttgaacgttttttattctcttggctatgaagtttcttaagtgactctagtaatactgatggttccccttgtgtttacaggtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436284 - DNA, 477 bp, Homo sapiens
tatataaataaatgtctacatttattacaaacgcacgccgctgagcattacgatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436285 - DNA, 464 bp, Homo sapiens
aaattaaaattatatgaatttcatgtcagttcattctggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436286 - DNA, 915 bp, Homo sapiens
gcagaggcggcccacgctgtccacatgcagaggctcgctacagaagctacagaagaagatggttacatttcaagtgggcaggtgccgtttgcttatgagcaccatcagccacatcagccacggttctttgaattttacctaattgtctctaattcttaacaattctttgaggtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggttggaatatgagagtaacattgggagaccagctgttgagattgagcatttaaagatggaagaataggagtttaggaagcaaagaggatg

SEQ ID NO: 436287 - DNA, 356 bp, Homo sapiens
  misc_feature (5)..(5): n is a, c, g, or t
cctangctgcactgactctcttaactaccacctctaccggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436288 - DNA, 506 bp, Homo sapiens
  misc_feature (52)..(52): n is a, c, g, or t
ttttaataaccggtttgtctatatcttgcaaataaaaaacaggtttcgggtnacgatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgaggatttggttgaggatgccatcaaaaaa

SEQ ID NO: 436289 - DNA, 614 bp, Homo sapiens
actatatttacttttattctcttctcatcgtgttgaacgaagaagcggaatgttaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgaggaaaaaaaaaattttgttatcaatgaatgagtgagaaaaaatggtttgttcttaaactattttatttccggccttgttggcctaatcggggaagtttttcggccctttcctttttgtgggggaaaatccaaga

SEQ ID NO: 436290 - DNA, 422 bp, Homo sapiens
agctcggtacctacttttcacagggcagtgatattttctcccctcagtccaataattctccaggagttgcaaaatgatttttctaattccgtcatcattccacatttatcagctaaaattcatacaactggagctatttagttactctaagatacaatttaaataggcaggttaagttctcctttcaggttcagtaatatgttttgcatcagtttttaaaaaataattgtattaacttagtttgtgctgctacaccaaaataccatagacggtaattcaccaagaacagaatttttttttttctcacagttccggaggctgggaagttcaagtcatgaaatccaagatgaaggtgccagcaggttgtctggtgagggctgctttccatttccaacatgatgtcttgttgctacatcctctgg

SEQ ID NO: 436291 - DNA, 1580 bp, Homo sapiens
gtggattttagagatacctcccctccttctgctcagctgccttgcagtaattaaactctttctctgctgcaacacccctactgttctccgtgtattggcttttctgggcagcagaatcttgctctgtcacccaggctggagtgcagtggcatgatcatagctcactgtagccgtgaactcctgggctcaagggatcctcctaccacttgccccaacttggactatagcgttagggaacaaaggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436292 - DNA, 1561 bp, Homo sapiens
gtgtgcgcgcagggcgcaggcgcgcgggtcccggcagcccgtgagacgcccgctgctggacgcgggtagccgtctgaggtgccggagctgcgggaggatggagccgctgaaggtggaaaagttcgcaaccgccaacaggggaaacgggctgcgcgccgtgaccccgctgcgccccggagagctactcttccgctcggatcccttggcgtacacggtgtgcaaggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436293 - DNA, 1958 bp, Homo sapiens
  misc_feature (1949)..(1949): n is a, c, g, or t
gtgtgcgcgcagggcgcaggcgcgcgggtcccggcagcccgtgagacgcccgctgctggacgcgggtagccgtctgaggtgccggagctgcgggaggatggagccgctgaaggtggaaaagttcgcaaccgccaacaggggaaacgggctgcgcgccgtgaccccgctgcgccccggagagctactcttccgctcggatcccttggcgtacacggtgtgcaaggggagtcgtggcgtcgtctgcgaccgctgccttctcgggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgaggaaaaaaaaaaaaaaaaaaaggggggcagataaaaaaataatacaataaggaggggccaaagataaagggttaacacaaagttttggtaaaaagggggtcccatatagggagtcgattataagctaggagggccgggttaacaacgtcgtgcgtgggaaaacggtgtagctggggatctggtgaggggaaccttacttctggggggtgaccatattggaccaaataccctaagagagttaagagtcctagggtacatataaaagtttcaagtgtatagggtgttaacctagatgattatgttgtgtggagagtgggctacagagttgattctgaccatttcttccgcgtcngataaagca

SEQ ID NO: 436294 - DNA, 1656 bp, Homo sapiens
gtgtgcgcgcagggcgcaggcgcgcgggtcccggcagcccgtgagacgcccgctgctggacgcgggtagccgtctgaggtgccggagctgcgggaggatggagccgctgaaggtggaaaagttcgcaaccgccaacaggggaaacgggctgcgcgccgtgaccccgctgcgccccggagagctactcttccgctcggatcccttggcgtacacggtgtgcaaggggagtcgtggcgtcgtctgcgaccgctgccttctcgggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgaggactgatgcggctcagatttttattttttggaataaacacaaaaaaaccccgaccccg

SEQ ID NO: 436295 - DNA, 1620 bp, Homo sapiens
  misc_feature (1603)..(1603): n is a, c, g, or t
  misc_feature (1609)..(1609): n is a, c, g, or t
  misc_feature (1620)..(1620): n is a, c, g, or t
gtgtgcgcgcagggcgcaggcgcgcgggtcccggcagcccgtgagacgcccgctgctggacgcgggtagccgtctgaggtgccggagctgcgggaggatggagccgctgaaggtggaaaagttcgcaaccgccaacaggggaaacgggctgcgcgccgtgaccccgctgcgccccggagagctactcttccgctcggatcccttggcgtacacggtgtgcaaggggagtcgtggcgtcgtctgcgaccgctgccttctcgggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgaggccgncgatgncgcccggaaan

SEQ ID NO: 436296 - DNA, 1488 bp, Homo sapiens
gtgtgcgcgcagggcgcaggcgcgcgggtcccggcagcccgtgagacgcccgctgctggacgcgggtagccgtctgaggtgccggagctgcgggaggatggagccgctgaaggtggaaaagttcgcaaccgccaacaggggaaacgggctgcgcgccgtgaccccgctgcgccccggagagctactcttccgctcggatcccttggcgtacacggtgtgcaaggggagtcgtggcgtcgtctgcgaccgctgccttctcgggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436297 - DNA, 1225 bp, Homo sapiens
gggcggaggccgtccctgaggaagtaggagaagaccactagggctgtgtctaagtcacagcgaaaagttgttccgtgagacctcttgcataatgactctaaggggcttcagagacattctcctgcgaggtaactgtgcctgtgatgtggggagagtgtgagactgggaagcagaagaccggaatgtgatacagcctttcccacgacttggctgaggaactgctgttgtgaaccttttgccctggtgggattattgtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436298 - DNA, 1676 bp, Homo sapiens
gtgtgcgcgcagggcgcaggcgcgcgggtcccggcagcccgtgagacgcccgctgctggacgcgggtagccgtctgaggtgccggagctgcgggaggatggagccgctgaaggtggaaaagttcgcaaccgccaacaggggaaacgggctgcgcgccgtgaccccgctgcgccccggagagctactcttccgctcggatcccttggcgtacacggtgtgcaaggggagtcgtggcgtcgtctgcgaccgctgccttctcgggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgaggcagataaaaaatgctgtcgcccgtcagcgccttgctgattattatgcacagagatgctctggatatgaataaaaaga

SEQ ID NO: 436299 - DNA, 1148 bp, Homo sapiens
tgccagcaaagaggcctgaacaagtaggtaatgagactgtctacacagaggttctgcgagcccacagctgcccactggaagacccgtttaggattaatatttcagatcatctattctgcttgctctgagattgatgcgcaagacacaaagcaacctctagacacttcagctaagaatgtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436300 - DNA, 1217 bp, Homo sapiens
aaaaatgaaagacttagcggtgttttttatattctactcttcctttcgtccaacgaaagttgttccgtgagacctcttgcataatgactctaaggggcttcagagacattctcctgcgaggtaactgtgcctgtgatgtggggagagtgtgagactgggaagcagaagaccggaatgtgatacagcctttcccacgacttggctgaggaactgctgttgtgaaccttttgccctggtgggattattgtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436301 - DNA, 1048 bp, Homo sapiens
  misc_feature (1)..(1): n is a, c, g, or t
  misc_feature (11)..(11): n is a, c, g, or t
  misc_feature (20)..(20): n is a, c, g, or t
nttgttgtggngggtgtgcncgggatatattatttttctttgtttttggcgccccccgtcctcccctaagaggactggtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436302 - DNA, 1490 bp, Homo sapiens
gtgtgcgcgcagggcgcaggcgcgcgggtcccggcagcccgtgagacgcccgctgctggacgcgggtagccgtctgaggtgccggagctgcgggaggatggagccgctgaaggtggaaaagttcgcaaccgccaacaggggaaacgggctgcgcgccgtgaccccgctgcgccccggagagctactcttccgctcggatcccttggcgtacacggtgtgcaaggggagtcgtggcgtcgtctgcgaccgctgccttctcgggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436303 - DNA, 1463 bp, Homo sapiens
gtgtgcgcgcagggcgcaggcgcgcgggtcccggcagcccgtgagacgcccgctgctggacgcgggtagccgtctgaggtgccggagctgcgggaggatggagccgctgaaggtggaaaagttcgcaaccgccaacaggggaaacgggctgcgcgccgtgaccccgctgcgccccggagagctactcttccgctcggatcccttggcgtacacggtgtgcaaggggagtcgtggcgtcgtctgcgaccgctgccttctcgggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggcgacactcgagtgtctcccacattaggcttaaaacagatgcaattcccggacgtctaacct

SEQ ID NO: 436304 - DNA, 1430 bp, Homo sapiens
gtgtgcgcgcagggcgcaggcgcgcgggtcccggcagcccgtgagacgcccgctgctggacgcgggtagccgtctgaggtgccggagctgcgggaggatggagccgctgaaggtggaaaagttcgcaaccgccaacaggggaaacgggctgcgcgccgtgaccccgctgcgccccggagagctactcttccgctcggatcccttggcgtacacggtgtgcaaggggagtcgtggcgtcgtctgcgaccgctgccttctcgggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatgcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436305 - DNA, 1449 bp, Homo sapiens
gtgtgcgcgcagggcgcaggcgcgcgggtcccggcagcccgtgagacgcccgctgctggacgcgggtagccgtctgaggtgccggagctgcgggaggatggagccgctgaaggtggaaaagttcgcaaccgccaacaggggaaacgggctgcgcgccgtgaccccgctgcgccccggagagctactcttccgctcggatcccttggcgtacacggtgtgcaaggggagtcgtggcgtcgtctgcgaccgctgccttctcgggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacagttgaagaagaccaggaaagaatcttcttttaaaaaactgagctctatctgtcctgattcctggtgctgcttcaggtatctaccttaattttcttatattcctatgaagacagtggtttggataattggaggtagctatacactgaaattattaaattgtttaccttcaaaacaggagtagaccagaaatgcaggtccttgtcctcagaactgcagttcacatcatattcagtaattaatttaatagtcacgttttcctcccaggctagacaggaag

SEQ ID NO: 436306 - DNA, 561 bp, Homo sapiens
  misc_feature (41)..(41): n is a, c, g, or t
gctccctcacccccagggattacaacaaaatttgaaatacnatggcccgttggattggaaattgaagaagaccaggaaagaatcttcttttaaaaaactgagctctatctgtcctgattcctggtgctgcttcaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436307 - DNA, 796 bp, Homo sapiens
agctcggtacctacttttcacagggcagtgatattttctcccctcagtccaataattctccaggagttgcaaaatgatttttctaattccgtcatcattccacatttatcagctaaaattcatacaactggagctatttagttactctaagatacaatttaaataggcaggttaagttctcctttcaggttcagtaatatgttttgcatcagtttttaaaaaataattgtattaacttagtttgtgctgctacaccaaaataccatagacggtaattcaccaagaacagaatttttttttttctcacagttccggaggctgggaagttcaagtcatgaaatccaagatgaaggtgccagcaggttgtctggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436308 - DNA, 490 bp, Homo sapiens
  misc_feature (18)..(18): n is a, c, g, or t
atatactgactaccagantctacacgaccacgctggccaccaccataggcgaattctggctaccgatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436309 - DNA, 1012 bp, Homo sapiens
actggtgaccaggccccatccgcccaggaacctgcctgcctcctgctgctgttcatggtgcccggactcagccctgactttgctcccaggtcggagtgggcatcgatagcagagagaagccaggcagctgaagcaggcatttctgagactgtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436310 - DNA, 817 bp, Homo sapiens
  misc_feature (800)..(800): n is a, c, g, or t
  misc_feature (806)..(806): n is a, c, g, or t
  misc_feature (817)..(817): n is a, c, g, or t
agctcggtacctacttttcacagggcagtgatattttctcccctcagtccaataattctccaggagttgcaaaatgatttttctaattccgtcatcattccacatttatcagctaaaattcatacaactggagctatttagttactctaagatacaatttaaataggcaggttaagttctcctttcaggttcagtaatatgttttgcatcagtttttaaaaaataattgtattaacttagtttgtgctgctacaccaaaataccatagacggtaattcaccaagaacagaatttttttttttctcacagttccggaggctgggaagttcaagtcatgaaatccaagatgaaggtgccagcaggttgtctggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgaggccgncgatgncgcccggaaan

SEQ ID NO: 436311 - DNA, 368 bp, Homo sapiens
  misc_feature (46)..(46): n is a, c, g, or t
atattatcattaacactcaattcatagccgaacaaatgaaaaaatngtcaggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436312 - DNA, 566 bp, Homo sapiens
gtgtgcgcgcagggcgcaggcgcgcgggtcccggcagcccgtgagacgcccgctgctggacgcgggtagccgtctgaggtgccggagctgcgggaggatggagccgctgaaggtggaaaagttcgcaaccgccaacaggggaaacgggctgcgcgccgtgaccccgctgcgccccggagagctactcttccgctcggatcccttggcgtacacggtgtgcaaggggagtcgtggcgtcgtctgcgaccgctgccttctcgggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagacaatacttgcaaaagtcctcagcacttattcccaacacttttgaaccttacaataaaccatgtttatcataagaaggtgcaacctgtcaatgggtcccgcctgcgta

SEQ ID NO: 436313 - DNA, 1452 bp, Homo sapiens
gtggattttagagatacctcccctccttctgctcagctgccttgcagtaattaaactctttctctgctgcaacacccctactgttctccgtgtattggcttttctgggcagcaggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436314 - DNA, 464 bp, Homo sapiens
ccttgcgtgaacgactctcttaatatccaccgctacacgatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436315 - DNA, 998 bp, Homo sapiens
tgccagcaaagaggcctgaacaagtaggtaatgagactgtctacacagaggttctgcgagcccacagctgcccactggaagacccgtttaggattaatatttcagatcatctattctgcttgctctgagattgatgcgcaagacacaaagcaacctctagacacttcagctaagaatgtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacagttgaagaagaccaggaaagaatcttcttttaaaaaactgagctctatctgtcctgattcctggtgctgcttcaggtatctaccttaattttcttatattcctatgaagacagtggtttggataattggaggtagctatacactgaaattattaaattgtttaccttcaaaacaggagtagaccagaaatgcaggtccttgtcctcagaactgcagttcacatcatattcagtaattaatttaatagtcacgttttcctcccaggctagacaggaag

SEQ ID NO: 436316 - DNA, 1599 bp, Homo sapiens
gtgtgcgcgcagggcgcaggcgcgcgggtcccggcagcccgtgagacgcccgctgctggacgcgggtagccgtctgaggtgccggagctgcgggaggatggagccgctgaaggtggaaaagttcgcaaccgccaacaggggaaacgggctgcgcgccgtgaccccgctgcgccccggagagctactcttccgctcggatcccttggcgtacacggtgtgcaaggggagtcgtggcgtcgtctgcgaccgctgccttctcgggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436317 - DNA, 1673 bp, Homo sapiens
gtgtgcgcgcagggcgcaggcgcgcgggtcccggcagcccgtgagacgcccgctgctggacgcgggtagccgtctgaggtgccggagctgcgggaggatggagccgctgaaggtggaaaagttcgcaaccgccaacaggggaaacgggctgcgcgccgtgaccccgctgcgccccggagagctactcttccgctcggatcccttggcgtacacggtgtgcaaggggagtcgtggcgtcgtctgcgaccgctgccttctcgggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacagttgaagaagaccaggaaagaatcttcttttaaaaaactgagctctatctgtcctgattcctggtgctgcttcaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436318 - DNA, 1677 bp, Homo sapiens
gtgtgcgcgcagggcgcaggcgcgcgggtcccggcagcccgtgagacgcccgctgctggacgcgggtagccgtctgaggtgccggagctgcgggaggatggagccgctgaaggtggaaaagttcgcaaccgccaacaggggaaacgggctgcgcgccgtgaccccgctgcgccccggagagctactcttccgctcggatcccttggcgtacacggtgtgcaaggggagtcgtggcgtcgtctgcgaccgctgccttctcgggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaaagatggggtcttgccatgttgcccagactggtcttcaactcctggtatcaagcgatcttcctgcctcagcctcacaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436319 - DNA, 1142 bp, Homo sapiens
gcagaggcggcccacgctgtccacatgcagaggctcgctacagaagctacagaagaagatggttacatttcaagtgggcaggtgccgtttgcttatgagcaccatcagccacatcagccacggttctttgaattttacctaattgtctctaattcttaacaattctttgaggtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436320 - DNA, 1625 bp, Homo sapiens
gtgtgcgcgcagggcgcaggcgcgcgggtcccggcagcccgtgagacgcccgctgctggacgcgggtagccgtctgaggtgccggagctgcgggaggatggagccgctgaaggtggaaaagttcgcaaccgccaacaggggaaacgggctgcgcgccgtgaccccgctgcgccccggagagctactcttccgctcggatcccttggcgtacacggtgtgcaaggggagtcgtggcgtcgtctgcgaccgctgccttctcgggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgaggatttggttgaggatgccatcaaaaaa

SEQ ID NO: 436321 - DNA, 1654 bp, Homo sapiens
gtgtgcgcgcagggcgcaggcgcgcgggtcccggcagcccgtgagacgcccgctgctggacgcgggtagccgtctgaggtgccggagctgcgggaggatggagccgctgaaggtggaaaagttcgcaaccgccaacaggggaaacgggctgcgcgccgtgaccccgctgcgccccggagagctactcttccgctcggatcccttggcgtacacggtgtgcaaggggagtcgtggcgtcgtctgcgaccgctgccttctcgggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgaggtcaagaggccggccgaccccgctcccccggcatggcgcactctcgtaccctgaag

SEQ ID NO: 436322 - DNA, 1530 bp, Homo sapiens
gtggattttagagatacctcccctccttctgctcagctgccttgcagtaattaaactctttctctgctgcaacacccctactgttctccgtgtattggcttttctgggcagcaggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaaagatggggtcttgccatgttgcccagactggtcttcaactcctggtatcaagcgatcttcctgcctcagcctcacaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436323 - DNA, 1030 bp, Homo sapiens
  misc_feature (59)..(59): n is a, c, g, or t
cactggccctcttgtatgcccggccagtccgcccgccactccaccctaaaccagttcgngtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436324 - DNA, 1025 bp, Homo sapiens
  misc_feature (26)..(27): n is a, c, g, or t
aaaataacttaaatcataaaaaaaannattgtgcacaggacgtgggcacattttgtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436325 - DNA, 1564 bp, Homo sapiens
gtgtgcgcgcagggcgcaggcgcgcgggtcccggcagcccgtgagacgcccgctgctggacgcgggtagccgtctgaggtgccggagctgcgggaggatggagccgctgaaggtggaaaagttcgcaaccgccaacaggggaaacgggctgcgcgccgtgaccccgctgcgccccggagagctactcttccgctcggatcccttggcgtacacggtgtgcaaggggagtcgtggcgtcgtctgcgaccgctgccttctcgggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacagttgaagaagaccaggaaagaatcttcttttaaaaaactgagctctatctgtcctgattcctggtgctgcttcaggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436326 - DNA, 1279 bp, Homo sapiens
  misc_feature (1272)..(1272): n is a, c, g, or t
  misc_feature (1275)..(1275): n is a, c, g, or t
gtgtgcgcgcagggcgcaggcgcgcgggtcccggcagcccgtgagacgcccgctgctggacgcgggtagccgtctgaggtgccggagctgcgggaggatggagccgctgaaggtggaaaagttcgcaaccgccaacaggggaaacgggctgcgcgccgtgaccccgctgcgccccggagagctactcttccgctcggatcccttggcgtacacggtgtgcaaggggagtcgtggcgtcgtctgcgaccgctgccttctcgggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagaatcttgagaactggctttttgataattattgagagtgaccaccatggncanagaa

SEQ ID NO: 436327 - DNA, 1105 bp, Homo sapiens
gcagaggcggcccacgctgtccacatgcagaggctcgctacagaagctacagaagaagatggttacatttcaagtgggcaggtgccgtttgcttatgagcaccatcagccacatcagccacggttctttgaattttacctaattgtctctaattcttaacaattctttgaggtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacagttgaagaagaccaggaaagaatcttcttttaaaaaactgagctctatctgtcctgattcctggtgctgcttcaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436328 - DNA, 472 bp, Homo sapiens
ctcttattcacactcttcttcccccaccccccaaacaaaaatcttggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436329 - DNA, 996 bp, Homo sapiens
gcagaggcggcccacgctgtccacatgcagaggctcgctacagaagctacagaagaagatggttacatttcaagtgggcaggtgccgtttgcttatgagcaccatcagccacatcagccacggttctttgaattttacctaattgtctctaattcttaacaattctttgaggtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacagttgaagaagaccaggaaagaatcttcttttaaaaaactgagctctatctgtcctgattcctggtgctgcttcaggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagg

SEQ ID NO: 436330 - DNA, 3864 bp, Homo sapiens
tgtcccctttgtttgaagctccagtgagggagcagtggctggggtggcccagcttcaaagtctctgtcctcttgaaaaaaggtggtcgggggacattgacccaccagccccgcaggctactgcctgcaaacaagaacccctcatctgccacgcacgttcttaatgtatctatagtctgcctgatgccacaaaggagtccagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcaccttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagatgcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagagcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 436331 - DNA, 3826 bp, Homo sapiens
gggtaccgggccccccctcgactctagcatgcgcacagcgggcgcagcaacaggctggcaggttaagcctctgggggtggatcctgaaaggtggtccagccgcctggccctgcgtgggaccctccacctggcagcaggtacccaaacaagggctggacagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcaccttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagatgcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagagcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 436332 - DNA, 350 bp, Homo sapiens
ggacgcgtgggtcgacggacgcgtgggtcgacccacgcgtccgccagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 436333 - DNA, 334 bp, Homo sapiens
tcggctaggtacgaggcctgggtggttgcagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 436334 - DNA, 348 bp, Homo sapiens
ccaagggccctgttgccgtggcaaccccggcctctctgtgggaactttggggagactggccctgggaggcgacagatggaggctgaggaagcagagtgatccccggccccttcctgtccctgaacactgtctgcctggatgagggctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcagtcgctctagcctgggccacagagcgagactccgtctc

SEQ ID NO: 436335 - DNA, 3785 bp, Homo sapiens
aagctggtactgggccgggccctcgaggctcaggcccttatggccggatcctgaaaggtggtccagccgcctggccctgcgtgggaccctccacctggcagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcaccttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccagggtgcccctgccgtgcaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagatgcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagagcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 436336 - DNA, 3919 bp, Homo sapiens
gcccggcgctgagtcatgggcatcccccaggatcactgcctcagcgctctcagccctgccccctcctggtctccctctgagaaatccatgactcacatatatcgtccgtcatccccagtcaagctcagggaggagggaggagcccagctggggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcaccttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagatgcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagagcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 436337 - DNA, 3692 bp, Homo sapiens
ctcacaaagagttggcagatcacggatggagggcagcatctcccaacagcctgggcggccgctgagacccagagaacccaaggactcccctgggctcatccagcagcctctgcttcccaggagagaggtgctgaagtccacgaagaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcaccttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagatgcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagagcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 436338 - DNA, 3746 bp, Homo sapiens
tgtcccctttgtttgaagctccagtgagggagcagtggctggggtggcccagcttcaaagtctctgtcctcttgaaaaaaggtggtcgggggacattgacccaccagccccgcaggctactgcctgcaaacaagaacccctcatctgccacgcacgttcttaatgtatctatagtctgcctgatgccacaaaggagtccaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcaccttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagatgcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagagcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 436339 - DNA, 3876 bp, Homo sapiens
gcccggcgctgagtcatgggcatcccccaggatcactgcctcagcgctctcagccctgccccctcctggtctccctctgagaaatccatgactcacatatatcgtccgtcatccccagtcaagctcagggaggagggaggagcccagctggggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcaggtggtgacttccaagagtgactccgtcggaggaaaatgactccccagtcgctgctgcagacgacactgttcctgctgagtctgctcttcctggtccaagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcaccttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagatgcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagagcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 436340 - DNA, 4206 bp, Homo sapiens
gtttatttcctttcacagaggaggaaactggggcacagagaggatgcccaaagctgcacagctagccaatgggagagccaggatttgaacccagcagctgattggagtggggtaggggtgaggggcggagtatgagaggtcaaaggtcaggaaagcagtggggttgactctgaggtccagaagctgcatcttcccccttgagtgtgacaggtacatgtggccactgccattcagcaccattaaatgctgaatggtggccaggaagggaggagcatcagaaggagcttgaaggtttactggggggttttcatgtctttccagcacctcaagtttgaggcagggctttcaggggtggggggcacagcactttgattgtgtcagtgtaacaggctaatgattatgtccagtgcaacaggcaggcccaggcccgtcagtggtggggggttccccacaccccaggctgggattctgccccgcaacctgggaggatttagggcaaagttgatcctagttgcaaattggcattctgaagaccagactgaacttggtcttgtttggcctgtagagggtttttaaaaaacatggaccagggatttcaaatcacctaaaacccaggctttctcggttatgcattcaaaagatggagctacccagggcctgccttcctcagtggcacagaaagtataccctccaacccccactgtttgtcttcctcatctgagtcccagctaatccctggagacaccttagtcggccgccttagtaggccgcccacgctactgggcagaggggcccgagcctggagtcagggaggctggtgggtgtggagtcccaggaaccaccaccaagccccgcacatccctcctaaggaggcctggctgggccctctctgctccgtgtgtgtagccgaaggtgtctgcggagggtgctgagcaaggcacatcccaccccatcccgctggggctggcattgctggcgggttctgtaagacacaacccccacgggttggcctcatctgagtggccttggcagagtccactctgcttcttgaagcctcagtttcccctttgtaaagtaaagatcgaggcattcagagtcatgtcagggtggtagggggcagaatgggagggtcctgggacctgaatcggcagcctcggcgggggcctgtccacccctcccccaggtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcaccttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagatgcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagagcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 436341 - DNA, 2607 bp, Homo sapiens
ggacgcgtgggtcgacggacgcgtgggtcgacccacgcgtccgcggtacagaacaccaaagtagccaacctcacggagcccgtggtgctcaccttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagatgcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagagcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 436342 - DNA, 2681 bp, Homo sapiens
gcccggcgctgagtcatgggcatcccccaggatcactgcctcagcgctctcagccctgccccctcctggtctccctctgagaaatccatgactcacatatatcgtccgtcatccccagtcaagctcagggaggagggaggagcccagctggggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcaggtacccaaacaagggctggacagcagggtctcgctctgtcacacaggctggagtgcagtggtgtgatcttggctcatcgtaacctccacctcccgggttcaagtgattctcatgcctcagcctcccgagtagctgggattacagctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagatgcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagagcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 436343 - DNA, 3902 bp, Homo sapiens
gcccggcgctgagtcatgggcatcccccaggatcactgcctcagcgctctcagccctgccccctcctggtctccctctgagaaatccatgactcacatatatcgtccgtcatccccagtcaagctcagggaggagggaggagcccagctggggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcaccttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccagggtgcccctgccgtgcaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagatgcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagagcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctgcaggaagtcttccaggattcccaggcaggaatgatggctccctgtccctgtagctccgtcgacggcctgcgaattta

SEQ ID NO: 436344 - DNA, 3816 bp, Homo sapiens
gcccggcgctgagtcatgggcatcccccaggatcactgcctcagcgctctcagccctgccccctcctggtctccctctgagaaatccatgactcacatatatcgtccgtcatccccagtcaagctcagggaggagggaggagcccagctggggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcaccttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccagggtgcccctgccgtgcaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagatgcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagagcctgacactctcctaagaggttctctccaagcccccaaatagctccaggcgccctcggccgcccatcatggttaattctgtccaacaaacatttatcagcagacaccaggcagtgtcctggaaaccactcccccaaaaaacagcattggaatcggggaccccccagcttgacgaagagcaagaggacctgggagaggat

SEQ ID NO: 436345 - DNA, 3777 bp, Homo sapiens
gcccggcgctgagtcatgggcatcccccaggatcactgcctcagcgctctcagccctgccccctcctggtctccctctgagaaatccatgactcacatatatcgtccgtcatccccagtcaagctcagggaggagggaggagcccagctggggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcaccttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccagggtgcccctgccgtgcaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagatgcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 436346 - DNA, 1224 bp, Homo sapiens
gtcccaacccagctgggacagatgtgggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagagcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 436347 - DNA, 581 bp, Homo sapiens
  misc_feature (25)..(25): n is a, c, g, or t
  misc_feature (31)..(31): n is a, c, g, or t
ggagcccatggaatttacgaatatncgagcntcggtacccgccctcttgtggcaagaactgtggaccatgccagtcccgtctggtttccatcccaccactccaaggactgagactgacctcctctggtgacactggcctagagcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 436348 - DNA, 448 bp, Homo sapiens
actgacattactcccgtttggtttcatcccaccactccatgcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 436349 - DNA, 450 bp, Homo sapiens
gcggccgcctactactactaaattcgcggccgcgtcgaccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 436350 - DNA, 1145 bp, Homo sapiens
gcccggcgctgagtcatgggcatcccccaggatcactgcctcagcgctctcagccctgccccctcctggtctccctctgagaaatccatgactcacatatatcgtccgtcatccccagtcaagctcagggaggagggaggagcccagctggggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtaaggcaacttccaggcggagggaacaactgggcagtggtctagaggcagggaaggcaaaatgcaaagtggactgggctcacaatatcagatcatgaagactgggctttgctcacaggcactggggagcc

SEQ ID NO: 436351 - DNA, 1087 bp, Homo sapiens
gcccggcgctgagtcatgggcatcccccaggatcactgcctcagcgctctcagccctgccccctcctggtctccctctgagaaatccatgactcacatatatcgtccgtcatccccagtcaagctcagggaggagggaggagcccagctggggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 436352 - DNA, 370 bp, Homo sapiens
ccggggtgtgacgtagtccctgcagctgccaacggttgccagggcaacggttgccaggggctgctgtcacctgcgccccttctcccgcgctggcggctggggcttctcagcctctattccctggctgtcccctttgtttgaagctccagtgagggagcagtggctggggtggcccagcttcaaagtctctgtcctcttgaaaaaaggtggtcgggggacattgacccaccagccccgcaggctactgcctgcaaacaagaacccctcatctgccacgcacgttcttaatgtatctatagtctgcctgatgccacaaaggagtccaggtacgattctcccgcctcctctcccctcctccccgtccctttca

SEQ ID NO: 436353 - DNA, 373 bp, Homo sapiens
agaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaaaactggcgtaagcattttgggtcatttccttctgagctttttcctgtgcttctattgaaagagtcactgatactaatacaaataccttggggccaatcaggaaacatgaaagagagaagagggctgtgtgtga

SEQ ID NO: 436354 - DNA, 4055 bp, Homo sapiens
gcccggcgctgagtcatgggcatcccccaggatcactgcctcagcgctctcagccctgccccctcctggtctccctctgagaaatccatgactcacatatatcgtccgtcatccccagtcaagctcagggaggagggaggagcccagctggggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcaccttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccagggtgcccctgccgtgcaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagatgcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagagcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 436355 - DNA, 3732 bp, Homo sapiens
ggaggaggtggaaggggaggagcaggccacacaggcacaggccggtgagggacctgcccagacctggagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcaccttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagatgcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagagcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 436356 - DNA, 3647 bp, Homo sapiens
gcagaggcagggcccttgcctgtggggccgtggttggtactgagcgcctgatggctgaggccctgtagcgctggggatctgcggctccagaggcagagacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcaccttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagatgcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagagcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 436357 - DNA, 3614 bp, Homo sapiens
ggaggaggtggaaggggaggagcaggccacacaggcacaggccggtgagggacctgcccagacctggaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcaccttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagatgcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagagcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 436358 - DNA, 3306 bp, Homo sapiens
  misc_feature (25)..(25): n is a, c, g, or t
ctggtacgccccggggttaatgggnatatcgtcgacccaggccgtcccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcaccttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagatgcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagagcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 436359 - DNA, 2714 bp, Homo sapiens
cttgacctaatgtagtgagaagaataaaacacaaatgatttatagtaaatgaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcaccttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagatgcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagagcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 436360 - DNA, 4130 bp, Homo sapiens
gcccggcgctgagtcatgggcatcccccaggatcactgcctcagcgctctcagccctgccccctcctggtctccctctgagaaatccatgactcacatatatcgtccgtcatccccagtcaagctcagggaggagggaggagcccagctggggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcaccttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccagggtgcccctgccgtgcaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagatgcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagagcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaaaaaaaaaataaacaaaaaagggggggcgcccaaaaatccccagggccaataccgacccgcgtttgtacacagggc

SEQ ID NO: 436361 - DNA, 1576 bp, Homo sapiens
  misc_feature (16)..(16): n is a, c, g, or t
catagctagtgaggcnggggtaatcggcgagggcggtgaggcccggggtggcccctcccctctgaagagcaactcagacagcgccaggctccccatcagctcgggcagcacctcgtccagccgcatctaggcctccagcccacctgcccatgtgatgaagcagagatgcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagagcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 436362 - DNA, 3759 bp, Homo sapiens
  misc_feature (3679)..(3679): n is a, c, g, or t
gcccggcgctgagtcatgggcatcccccaggatcactgcctcagcgctctcagccctgccccctcctggtctccctctgagaaatccatgactcacatatatcgtccgtcatccccagtcaagctcagggaggagggaggagcccagctggggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcaccttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccagggtgcccctgccgtgcaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagatgcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagagcctgacactctcctaagaggttctctccaagcccccaaatagctccagggggagtagatagnaaggccaggaaaccctagttgtccaaaaaggcattggataaaaggataatcctatttattacgtaagaacattttttctt

SEQ ID NO: 436363 - DNA, 3587 bp, Homo sapiens
gcccggcgctgagtcatgggcatcccccaggatcactgcctcagcgctctcagccctgccccctcctggtctccctctgagaaatccatgactcacatatatcgtccgtcatccccagtcaagctcagggaggagggaggagcccagctggggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcaccttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagatgcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggggcccaaggggcaaggaccctctccaagggcccaagaagccccctggggtcggaagggacgcatggcgcccttttgggccaagggaagccaccagggcaaggcaaaggattaggggcttaacctctactggaggccccagggggcccccgggcgatcggcacattcgcgcattcaaaggcgcgcatccgcaaggaggcgaccatatcacccgtatccaagagagcactcataccacaccattggggacaccagtgacacacaacacaatacacaatacacttaccccatatatgagggccacgtccacaatagggcacatccccccaaaataccgcgaaagcacaacaaaaaagaccactggcggcgcagcgagcaaacacaaccagagaaaaacaccaccacccaaagagtaggcaagagatacgcaaacaacaaaaaaggagacaacgcgaaccaacctgcagcagcacacacacacaaacaaccagacacccaccacaagggca

SEQ ID NO: 436364 - DNA, 1129 bp, Homo sapiens
gcccggcgctgagtcatgggcatcccccaggatcactgcctcagcgctctcagccctgccccctcctggtctccctctgagaaatccatgactcacatatatcgtccgtcatccccagtcaagctcagggaggagggaggagcccagctggggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtaaggcaacttccaggcggagggaacaactgggcagtggtctagaggcagggaaggcaaaatgcaaagtggactgggctctcggcgtgtgcaacgccgagtgaccatactgacc

SEQ ID NO: 436365 - DNA, 1027 bp, Homo sapiens
gcccggcgctgagtcatgggcatcccccaggatcactgcctcagcgctctcagccctgccccctcctggtctccctctgagaaatccatgactcacatatatcgtccgtcatccccagtcaagctcagggaggagggaggagcccagctggggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtaaggcaacttccaggcggagggaacaactgggcagtggtctagaggcagggaaggcaaaatgcaaagtggactgggctcacaatatcagatcatgaagactgggctttgctcacaggcactggggagcc

SEQ ID NO: 436366 - DNA, 774 bp, Homo sapiens
acgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtggtaagtatagaagaagaatttgttttgggaagtggagtttaaactgtgggtgttgtttagcagtcagtagaaaaacttaatttctaaaaactaaaagttaaatttaggtttttaaaaaactgccaatttcttcattatagataatcctaacttaaagaatgaa

SEQ ID NO: 436367 - DNA, 6400 bp, Homo sapiens
acgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttggagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgt

SEQ ID NO: 436368 - DNA, 6453 bp, Homo sapiens
acgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttggagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgtagaattataaacagtatcaagaatttagaccacaaagtcagtcgacgcggccg

SEQ ID NO: 436369 - DNA, 1942 bp, Homo sapiens
acgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgataaaaaaaaaaaaaaaaaaaaaaaaaaacaaaaaaaaaaaaaaaaaaaaaaaaaaaaaaaaacaaaaaaacgaacgagcaagacgaagaacaaaaaaagacagagagaaactgagataaaaaaaaacacaacagggggcgggcggacgaccaagcagacgacacgcagtggaaataagcagaaaatgtagtgtgaagcgccaccgaggagagataacagaagggaagaggaaaaacagacgagaggagaaaagagaaaagagagaagagagacaaatggcgggagagaaaagaaaagaacaact

SEQ ID NO: 436370 - DNA, 6163 bp, Homo sapiens
gccaatctacacacgtcactgaagcgagccaagacgagcgacaacccgtctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttggagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgt

SEQ ID NO: 436371 - DNA, 6342 bp, Homo sapiens
tttcatgcccttgttttaaaaaaactactttttttggcctcaaaaaaatcaagggtgtaatttttaataaattgttaatcctatgttttgtaattttcattttaggagcttgacttatttttttctctctcataaaaacacatttgttttaattgtaggagaaattttctcagcattttgcatgttctttctaatctttgttggtctgaatatattggtagtaattactgtaattattcaacaaaaagcatatccgttcaaaaatttttccactatgtcttttttctagtggctactgttttagttttctagttgaatatctctgacaagctttcgtatggttttgttatattaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttggagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgt

SEQ ID NO: 436372 - DNA, 6346 bp, Homo sapiens
acgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttggagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgt

SEQ ID NO: 436373 - DNA, 6535 bp, Homo sapiens
acgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgggtataactccaccagggaatgctccgactgtcacttcaatgagcagcatcaacaacacagttgcaacacctgccagttatcacacgaaggatgaccccaggggactcagtgtgttgaaacaggagaaacagaagaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttggagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgt

SEQ ID NO: 436374 - DNA, 6155 bp, Homo sapiens
agcggataggccgctggccttccttcctcgcgcgctgggcgtgctcggggaacctccgaggccgcgagcagatcctggtcctagatcaggccagagacctcaaattcaagccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttggagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgt

SEQ ID NO: 436375 - DNA, 6097 bp, Homo sapiens
agtgcgtttacaaatttctttgaatagaagtgtaagtgagctacttgttgggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttggagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgt

SEQ ID NO: 436376 - DNA, 6346 bp, Homo sapiens
acgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttggagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgt

SEQ ID NO: 436377 - DNA, 5861 bp, Homo sapiens
gtcactttaagcccatgctccatctagccccaaagtccggcagtttccaatcggattagtttgctgtacccttggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttggagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgt

SEQ ID NO: 436378 - DNA, 5837 bp, Homo sapiens
  misc_feature (40)..(40): n is a, c, g, or t
accacaaaacaccacaccacacacgaaagggaagaccccnaaatttcatggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttggagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgt

SEQ ID NO: 436379 - DNA, 5846 bp, Homo sapiens
gccgccaccataaacccacaacgaacaaaaagagaaaagaaaccccccccccttcagtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttggagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgt

SEQ ID NO: 436380 - DNA, 5823 bp, Homo sapiens
  misc_feature (12)..(12): n is a, c, g, or t
  misc_feature (22)..(22): n is a, c, g, or t
agcctgactctngaggaaaacnagagcacactgcaacacagttgcaacacctgccagttatcacacgaaggatgaccccaggggactcagtgtgttgaaacaggagaaacagaagaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttggagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgt

SEQ ID NO: 436381 - DNA, 5744 bp, Homo sapiens
gttagttaaaaaattcccaatatctttgtaatgcagaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttggagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgt

SEQ ID NO: 436382 - DNA, 6062 bp, Homo sapiens
acgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaagaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttggagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgt

SEQ ID NO: 436383 - DNA, 5787 bp, Homo sapiens
  misc_feature (76)..(76): n is a, c, g, or t
cgcgggaagtgggagacccgctgcggaggttttacgacaccccgagaaagaagcccccccgtcaggatggactggnaacaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttggagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgt

SEQ ID NO: 436384 - DNA, 5786 bp, Homo sapiens
  misc_feature (29)..(29): n is a, c, g, or t
tttatattatttgtgcacgaacaaacggnggggggggagactagtctgcgacgactctcttaatttccaccgctacacaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttggagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgt

SEQ ID NO: 436385 - DNA, 5779 bp, Homo sapiens
  misc_feature (27)..(27): n is a, c, g, or t
atattaagtttattcatataaacaggnggaggaagctagcggcactgatctcttaactaccaccgctacagaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttggagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgt

SEQ ID NO: 436386 - DNA, 1669 bp, Homo sapiens
acgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactcagatgcggcagttctctttctccgtcccggtgatcaaggtgttgatttat

SEQ ID NO: 436387 - DNA, 5916 bp, Homo sapiens
actcttctttaattatatttttagtgggatttaaaaaaaggtaaatatagcctatctaacttttgctttttaggaatacatttctcagctccagttttaaaaaatcagtgttattgaggtataatttatatcccatggagacacccactgtgagtgtacaattcattgatacatagaactttgtaaccatcactatagttcagttttagaatgtctatcacccccggaaagtttccttatgtggttagcagttaatccccttttccgtccccagccataggcaaccactaatctactttccgtccctatagatttttagctccagtagtctcgttagtatgcttgtttttaaaaaccttttgtgtgtgtgttttttttctaggatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttggagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgt

SEQ ID NO: 436388 - DNA, 5325 bp, Homo sapiens
tgctagtgatgatctggtaagatacaacctgtccagtagccggacagttcatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttggagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgt

SEQ ID NO: 436389 - DNA, 5025 bp, Homo sapiens
gaccgttggtgtgcgtgttagctcgtgaaatatggaggatgtagattgggggtgcgggtgggctggggggtgggggaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttggagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgt

SEQ ID NO: 436390 - DNA, 928 bp, Homo sapiens
acgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgggtataactccaccagggaatgctccgactgtcacttcaatgagcagcatcaacaacacagttgcaacacctgccagttatcacacgaaggatgaccccaggggactcagtgtgttgaaacaggagaaacagaagaatgatatgtacctatcaaactggtcactgaatgcctctaaccagatggacctttgccccacagtggttacttatgatccgaacaaggaactattggtggt

SEQ ID NO: 436391 - DNA, 3549 bp, Homo sapiens
acgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattcctta

SEQ ID NO: 436392 - DNA, 1659 bp, Homo sapiens
acgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacggggggggtgcccggccccctttttataacatcaaacgccctagggctgttaaagggtttttagttttttcgggggggggaa

SEQ ID NO: 436393 - DNA, 5260 bp, Homo sapiens
tactactactaaattcagcggccgtcgactctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttggagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgt

SEQ ID NO: 436394 - DNA, 6845 bp, Homo sapiens
acgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataagtgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttcttttttttttggagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattagagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaacagttggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgtggtctaaattcttgatactgtttataattctacaaagaacaaaaattgttacgtactataggcacttaagaaccctgaggaaaaataatacaatgtgtgtgtgtgagagagagagtgagttactgacattgttccaaaaaaaaaaaaaaaaaaaaaaaaaatgtggagggttgaaatggtaaggaattggaatcttttgtattttcgagcaataagaattcctattcttgtttcaaatagaggtttgttaggaattacagttgtggggagcaaactttcttttttgtgctgttttaatccaaaatgtatatccttaattgtatataatatgtagataaatatatgagggtattaagctactttgaattaaatttaaggatatatttcacatgaaaacaaatacaaacttgagaatcaaaataaagttttgcaaagtatttctttg

SEQ ID NO: 436395 - DNA, 1025 bp, Homo sapiens
tatacttaattaagaaagttgaaaatggtttgtgtcttactaataggactcacctgaagactctactttgccaagagggaatttttaactcaaagttgtgtcagccagcacggggtagagccatggtcctcatacttgctggcatccctcatctggtggtctgttaaagcacagattgctgggccgcaccctcagggtgtgtgattgtgtgattcagtattgctgggtggtgcccaaatgctccagttctaatgtattcccaggtgttgctgatgctggtgattgggtaccacattttgagaaccatggggcattggcaatcaacaaatgcaatgcttgtgacttgacgtgataaaagttcatttattgggcaggcaaagtcctctgcaggcctggaaaccctccgagacaattacttgcatggggtaacccagtaatactgtgggatgcaccttctagggcatggctgcctccttcctagaggcagcagggggagaaaacactggaagaggtcaccccaacaattccatcgtaccttggcctaggagtgacctcctcagtctcacaaccctttggctagaactagtcatgtgacctcacaggaggtggagcagtgtcgtcaatgttatcatccccctgcacctgcaaggaaggaggcccagatgtgtgtaggtgctggatgtctcttccccaaaacatataactctggatttggaaaacaaaactggatataacagaaaagaaaaggaggggagaaggaaagttgaagaaattggtgaaatcagaataggacagtgaaaggcataaagattttcttctgaaacgctaagatcggttgatatttgtctaatacagctttaaatagagtatcactttgggccaaagaaaattgatataaacatacataaagtggaactaagattgacttcttcctagacatctctgcctctgtccacaaaatggaaacttccatcaaggagtactggaggacagttcagtatttcttcttatttgctcctccctat

SEQ ID NO: 436396 - DNA, 1043 bp, Homo sapiens
tatacttaattaagaaagttgaaaatggtttgtgtcttactaataggactcacctgaagactctactttgccaagagggaatttttaactcaaagttgtgtcagccagcacggggtagagccatggtcctcatacttgctggcatccctcatctggtggtctgttaaagcacagattgctgggccgcaccctcagggtgtgtgattgtgtgattcagtattgctgggtggtgcccaaatgctccagttctaatgtattcccaggtgttgctgatgctggtgattgggtaccacattttgagaaccatggggcattggcaatcaacaaatgcaatgcttgtgacttgacgtgataaaagttcatttattgggcaggcaaagtcctctgcaggcctggaaaccctccgagacaattacttgcatggggtaacccagtaatactgtgggatgcaccttctagggcatggctgcctccttcctagaggcagcagggggagaaaacactggaagaggtcaccccaacaattccatcgtaccttggcctaggagtgacctcctcagtctcacaaccctttggctagaactagtcatgtgacctcacaggaggtggagcagtgtcgtcaatgttatcatccccctgcacctgcaaggaaggaggcccagatgtgtgtaggtgctggatgtctcttccccaaaacatataactctggatttggaaaacaaaactggatataacagaaaagaaaaggaggggagaaggaaagttgaagaaattggtgaaatcagaataggacagtgaaaggcataaagattttcttctgaaacgctaagatcggttgatatttgtctaatacagctttaaatagagtatcactttgggccaaagaaaattgatataaacatacataaagtggaactaagattgacttcttcctagacatctctgcctctgtccgcaggagggaacttcaccgtcagagtcgtggtgaccagaccccattcctagatgatgcctgctgatcgaactgtaagatcccccctgac

SEQ ID NO: 436397 - DNA, 1535 bp, Homo sapiens
cccaggtagctgggatacaggtgcacgccaccacacccaggctagtttttctaaatattggagttcccaaagagtattcaaactgatgtgatattttaaaagacattttgtaagcatcttttaggaatatcagtaagtggaagattattatgctaggtatcagcagagtgccctcttataatttgtgtgaaatggaaacaaaggtaacatcgtgttttcaattcacacatatatacaagtaatgagaggtccagaagaaatgtggcttcagctctgctgctactgtgcctcccttctcctgccccactcagcccacaaaataggctggacactcaaaaaacgttgcgtttatctaccttttagagagggtgaatagcagagaactggaggtgggaatggtaaggaactcccagcagggtagtggagggaatgggctgacgcatctaaggctgatgccaggtctgctccctatctgggtggcctcagcaaatgacgtccagcacatccaggggcaggctcaagggagaacagcccccaaagctaagatcctgccaagctaaatacagtagttctaatgaaatgtgagaggctataatcccatttgggaaattcctaaaaagtcatgaggcaggggattggtttatgttattatcatgacctgagagtcatggctcagagccaaatgttcaggattgaattcaacagcatttaaatgtctttagagcaggatggaaatatgttagcaatgcctgcagagtgccaagtaaacgcaaaagccaatgagatcataaaggaagttgttagctaacctaggtggagtcgccaacttccttctactctaataattaaaaataaaaataatacttgggaggtaactggaataaaggttctaaaatcaaaaccctctgaagggtgaaaactgggagcctcctgttcccatagtaaccacagcactcagggcactgtctcccagcgctggagtactgtcttatgaccagagatcctaagcaacctctgctcatctgagttgtccaccatattgtgggcatgagtccttgacaatagtaaatagcacctctgttcccttattgggtaaatgattttccaactctgggaatgtgtagaattcattatggaaataatgcaataattcaaatccataatattgatactttcatgttaagtttaggactaatcttgtgtatgctccttaagtgatttgaatctttaaaaagcttatgattccaatttgaaatgtgaaattgattttacgtttgtgatttgaagttgaaaggtataagaatatttaacttagctcatgaaaagtattagactagatttactataagtttaatgtattagatttacaagagatgcttaaatatatgagaatgttttgtcttaattggttataatcttgtcatatcaatgatttgaagtgctaaaatagaaaattaaatatgataaattacacaagaagtttagaatgtttaaaagattttaataaacaaagcctataactaagaaaaaaaaat

SEQ ID NO: 436398 - DNA, 925 bp, Homo sapiens
gattttcttctgaaacgctaagatcggttgatatttgtctaatacagctttaaatagagtatcactttgggccaaagaaaattgatataaacatacataaagtggaactaagattgacttcttcctagacatctctgcctctgtccacaaaatggaaacttccatcaaggagtactggaggacagttcagtatttcttcttatttgctcctccctatgaaaggaagagtgacttctctgctgcatgatattgggggtaaatagttattgcacatttgctcaaaccccagcaaagtgcaccccattttaagccaaatttacaaacttacaaagatgatccaccaatagttttctctatttactttattcttgctctgtcacccaggctagaatgcagtggtgtgattatagctcactgcagcctccaacttctggactcaagtgatcctcccaccttagcttcccaggtagctgggatacaggtgcacgccaccacacccaggctagtttttctaaatattggagttcccaaagagtattcaaactgatgtgatattttaaaagacattttgtaagcatcttttaggaatatcagtaagtggaagaaaaacacatagttatcagtggatattatgccagagaggcatgagaaatataattttattatgctaggtatcagcagagtgccctcttataatttgtgtgaaatggaaacaaaggtaacatcgtgttttcaattcacacatatatacaagtaatgagaggtccagaagaaatgtggcttcagctctgctgctactgtgcctcccttctcctgccccactcagcccacaaaataggctggacactcaaaaaacgttgcgtttatctaccttttagagagggtgaatagcagagaactggaggtgggaatggtaaggaactcc

SEQ ID NO: 436399 - DNA, 2280 bp, Homo sapiens
ggaggaagagagcagagtttggccgggcaccttccctgcgaaaaggcgggcggagccgaaaaccaaacaaacgacttctgagagattgggggcgggactgacggcggccggcttagcttccagagccaaggccttccgccgagttggtttttgggttgttgatcgcggtggccgggcggtctgcggtcgggctgagacacgcggagcaatggcgacctttgtgagcgagctggaggcggccaagaagaacttaagcgaggccctgggggacaacgtgaaacaatactgggctaacctaaagctgtggttcaagcagaagatcagcaaagaggagtttgaccttgaagctcatagacttctcacacaggataatgtccattctcacaatgatttcctcctggccattctcacgcgttgtcagattttggtttctacaccagatggtgctggatctttgccttggccagggggttccgcagcaaaacctggaaaacccaagggaaagaaaaagctttcttctgttcgtcagaaatttgatcatagattccagcctcaaaatcctctctcaggagcccagcaatttgtggcaaaggatccccaagatgatgacgacttgaaactttgttcccacacaatgatgcttcccactcgaggccagcttgaagggagaatgatagtgactgcttatgagcatgggctggacaatgtcaccgaggaggctgtttcagctgttgtctatgctgtggagaatcaccttaaagatatactgacgtcagttgtgtcaagaaggaaagcttatcggttacgagatggtcattttaaatatgcctttggcagtaacgtgaccccgcagccatacctgaagaatagtgtagtagcttacaacaacttaatagaaagccctccagcttttactgctccctgtgctggtcagaatccagcttctcacccaccccctgatgatgctgagcagcaggctgcactcctgctggcatgctccggagacactctacctgcatctttgcctccggtgaacatgtacgatctttttgaagctttgcaggtgcacagggaagtcatccctacacatactgtctatgctcttaacattgaaaggatcatcacgaaactctggcatccaaatcatgaagagctgcagcaagacaaagttcaccgccagcgcttggcagccaaggaggggcttttgctgtgctaaattaggatttgagggtgtgggaccctcaccgaattcattgattactgaaaattgaatgttttttgggtccacatttcaaggctgaagtgtatagtgtatatataacctttcctatggaaatgtgacattgagtacattttgtgttgctgttgtgaagccattaatataaatctttggtaatgacccatatctctatatgtatgtgttcccagttgtgggagcaggcactaatgaaatcctgtgcctggaatggagatatttaggtacctgaggcttagtgtcctgtggtctgcatgtaagatagatgacatcctagaacaaagaagctgttttaacttaatccccctgatcagcaggatatctgtgtgttcagtgacatcatacattctgtatctagaagtctaaaatttctgcctttctcctaaagaatgtgttcttgcattttggttgaaataacctacacagtgttaaaaatcagatacctcctttagtgaccagttcaaattttaatagcgataggtagcccctgagaaatttatcactataactccacaggaaatatgacttggaagtgctctgtgtactaaacaaaataaagcccctctttgcatttaaaaccaaagtcaaaacaaaactcttgtaatgcaattaattaactttatgtcttcccatgactcaagttttgttaaatatgcccaaaaactttgattggcagtttcttcggttaattattcctatagaatgtattttaagaaatctatacaaattggatatatgcttggtaattctccagtttctaggaggtacctatttctaccgtttcaagtgatgaagtgaaaataatttacattcgatagtgttactgataacaaacctacttaagagatatgttgctttttacttaagggatagtgttgatagataaattagaatgtatagataggtttgtgaaagtctaaataatggttgtatagatatgtatatatggttcacatatctggatctgtgtatttgattttgtactttaaatgtgacaaataaaccttttgggaaaaaaaaaaaaa

SEQ ID NO: 436400 - DNA, 2122 bp, Homo sapiens
ggaggaagagagcagagtttggccgggcaccttccctgcgaaaaggcgggcggagccgaaaaccaaacaaacgacttctgagagattgggggcgggactgacggcggccggcttagcttccagagccaaggccttccgccgagttggtttttgggttgttgatcgcggtggccgggcggtctgcggtcgggctgagacacgcggagcaatggcgacctttgtgagcgagctggaggcggccaagaagaacttaagcgaggccctgggggacaacgtgaaacaatggtgctggatctttgccttggccagggggttccgcagcaaaacctggaaaacccaagggaaagaaaaagctttcttctgttcgtcagaaatttgatcatagattccagcctcaaaatcctctctcaggagcccagcaatttgtggcaaaggatccccaagatgatgacgacttgaaactttgttcccacacaatgatgcttcccactcgaggccagcttgaagggagaatgatagtgactgcttatgagcatgggctggacaatgtcaccgaggaggctgtttcagctgttgtctatgctgtggagaatcaccttaaagatatactgacgtcagttgtgtcaagaaggaaagcttatcggttacgagatggtcattttaaatatgcctttggcagtaacgtgaccccgcagccatacctgaagaatagtgtagtagcttacaacaacttaatagaaagccctccagcttttactgctccctgtgctggtcagaatccagcttctcacccaccccctgatgatgctgagcagcaggctgcactcctgctggcatgctccggagacactctacctgcatctttgcctccggtgaacatgtacgatctttttgaagctttgcaggtgcacagggaagtcatccctacacatactgtctatgctcttaacattgaaaggatcatcacgaaactctggcatccaaatcatgaagagctgcagcaagacaaagttcaccgccagcgcttggcagccaaggaggggcttttgctgtgctaaattaggatttgagggtgtgggaccctcaccgaattcattgattactgaaaattgaatgttttttgggtccacatttcaaggctgaagtgtatagtgtatatataacctttcctatggaaatgtgacattgagtacattttgtgttgctgttgtgaagccattaatataaatctttggtaatgacccatatctctatatgtatgtgttcccagttgtgggagcaggcactaatgaaatcctgtgcctggaatggagatatttaggtacctgaggcttagtgtcctgtggtctgcatgtaagatagatgacatcctagaacaaagaagctgttttaacttaatccccctgatcagcaggatatctgtgtgttcagtgacatcatacattctgtatctagaagtctaaaatttctgcctttctcctaaagaatgtgttcttgcattttggttgaaataacctacacagtgttaaaaatcagatacctcctttagtgaccagttcaaattttaatagcgataggtagcccctgagaaatttatcactataactccacaggaaatatgacttggaagtgctctgtgtactaaacaaaataaagcccctctttgcatttaaaaccaaagtcaaaacaaaactcttgtaatgcaattaattaactttatgtcttcccatgactcaagttttgttaaatatgcccaaaaactttgattggcagtttcttcggttaattattcctatagaatgtattttaagaaatctatacaaattggatatatgcttggtaattctccagtttctaggaggtacctatttctaccgtttcaagtgatgaagtgaaaataatttacattcgatagtgttactgataacaaacctacttaagagatatgttgctttttacttaagggatagtgttgatagataaattagaatgtatagataggtttgtgaaagtctaaataatggttgtatagatatgtatatatggttcacatatctggatctgtgtatttgattttgtactttaaatgtgacaaataaaccttttgggaaaaaaaaaaaaa

SEQ ID NO: 436401 - DNA, 2226 bp, Homo sapiens
ggaggaagagagcagagtttggccgggcaccttccctgcgaaaaggcgggcggagccgaaaaccaaacaaacgacttctgagagattgggggcgggactgacggcggccggcttagcttccagagccaaggccttccgccgagttggtttttgggttgttgatcgcggtggccgggcggtctgcggtcgggctgagacacgcggagcaatggcgacctttgtgagcgagctggaggcggccaagaagaacttaagcgaggccctgggggacaacgtgaaacaatactgggctaacctaaagctgtggttcaagcagaagatcagcaaagaggagtttgaccttgaagctcatagacttctcacacaggataatgtccattctcacaatgatttcctcctggccattctcacgcgttgtcagattttggtttctacaccagatggtgctggatctttgccttggccagggggttccgcagcaaaacctggaaaacccaagggaaagaaaaagctttcttctgttcgtcagaaatttgatcatagattccagcctcaaaatcctctctcaggagcccagcaatttgtggcaaaggatccccaagatgatgacgacttgaaactttgttcccacacaatgatgcttcccactcgaggccagcttgaagggagaatgatagtgactgcttatgagcatgggctggacaatgtcaccgaggaggctgtttcagctgttgtctatgctgtggagaatcaccttaaagatatactgacgtcagttgtgtcaagaaggaaagcttatcggttacgagatggtcattttaaatatgcctttggcagtaacgtgaccccgcagccatacctgaagaatagtgtagtagcttacaacaacttaatagaaagccctccagcttttactgctccctgtgctggtcagaatccagcttctcacccaccccctgatgatgctgagcagcaggctgcactcctgctggcatgctccggagacactctacctgcatctttgcctccggtgaacatgtacgatctttttgaagctttgcaggtgcacagggaagtcatccctacacatactgtctatgctcttaacattgaaaggatcatcacgaaactctggcatccaaatcatgaagagctgcagcaagacaaagttcaccgccagcgcttggcagccaaggaggggcttttgctgtgctaaattaggatttgagggtgtgggaccctcaccgaattcattgattactgaaaattgaatgttttttgggtccacatttcaaggctgaagtgtatagtgtatatataacctttcctatggaaatgtgacattgagtacattttgtgttgctgttgtgaagccattaatataaatctttggtaatgacccatatctctatatgtatgtgttcccagttgtgggagcaggcactaatgaaatcctgtgcctggaatggagatatttaggtacctgaggcttagtgtcctgtggtctgcatgtaagatagatgacatcctagaacaaagaagctgttttaacttaatccccctgatcagcaggatatctgtgtgttcagtgacatcatacattctgtatctagaagtctaaaatttctgcctttctcctaaagaatgtgttcttgcattttggttgaaataacctacacagtgttaaaaatcagatacctcctttagtgaccagttcaaattttaatagcgataggtagcccctgagaaatttatcactataactccacaggaaatatgacttggaagtgctctgtgtactaaacaaaataaagcccctctttgcatttaaaaccaaagtcaaaacaaaactcttgtaatgcaattaattaactttatgtcttcccatgactcaagttttgttaaatatgcccaaaaatctatacaaattggatatatgcttggtaattctccagtttctaggaggtacctatttctaccgtttcaagtgatgaagtgaaaataatttacattcgatagtgttactgataacaaacctacttaagagatatgttgctttttacttaagggatagtgttgatagataaattagaatgtatagataggtttgtgaaagtctaaataatggttgtatagatatgtatatatggttcacatatctggatctgtgtatttgattttgtactttaaatgtgacaaataaaccttttgggaaaaaaaaaaaaa

SEQ ID NO: 436402 - DNA, 2077 bp, Homo sapiens
tttgaatgttatattcctgtagttaaggtctgttagttttttcaactggaagttcagtatcctgagctaggtaaatattttaacattgtggaagaaggagggtaaatatagttgtattatgttttatttccagcctttaaaaattaaaattacagattattcatgtctacaggagtagacattgaatggatttctaattcaattaaagattttttaaataagattctagcaggccactcctgtccttgttgctcagttgtctctgtgctgggactatttctgaaatttttattttcagccctccagcttttactgctccctgtgctggtcagaatccagcttctcacccaccccctgatgatgctgagcagcaggctgcactcctgctggcatgctccggagacactctacctgcatctttgcctccggtgaacatgtacgatctttttgaagctttgcaggtaagtcttggctccttaaagtttacctaggtttatggataggttaagagattctttaagtctacaaaggtattcactggttttttccacttcttggctttgtgtttttcagttttgtctgttataaaagccgttattaatactagcctcatttttcaaatcctgagcccatcttctatctccccaataaagaaagaaaagaaaaaaaatcccttgttctgctattcctgtttcagaagcttgttatttccttattattatccaattggtgattcattttagtgtatgactgaaagtttatagattgtgtgtatgttttgttgatataaacccttttatatgtcagaaaaataagtctactcaagtataattggacatgcgttaattttttaatcccaggtgcacagggaagtcatccctacacatactgtctatgctcttaacattgaaaggatcatcacgaaactctggcatccaaatcatgaagagctgcagcaagacaaagttcaccgccagcgcttggcagccaaggaggggcttttgctgtgctaaattaggatttgagggtgtgggaccctcaccgaattcattgattactgaaaattgaatgttttttgggtccacatttcaaggctgaagtgtatagtgtatatataacctttcctatggaaatgtgacattgagtacattttgtgttgctgttgtgaagccattaatataaatctttggtaatgacccatatctctatatgtatgtgttcccagttgtgggagcaggcactaatgaaatcctgtgcctggaatggagatatttaggtacctgaggcttagtgtcctgtggtctgcatgtaagatagatgacatcctagaacaaagaagctgttttaacttaatccccctgatcagcaggatatctgtgtgttcagtgacatcatacattctgtatctagaagtctaaaatttctgcctttctcctaaagaatgtgttcttgcattttggttgaaataacctacacagtgttaaaaatcagatacctcctttagtgaccagttcaaattttaatagcgataggtagcccctgagaaatttatcactataactccacaggaaatatgacttggaagtgctctgtgtactaaacaaaataaagcccctctttgcatttaaaaccaaagtcaaaacaaaactcttgtaatgcaattaattaactttatgtcttcccatgactcaagttttgttaaatatgcccaaaaactttgattggcagtttcttcggttaattattcctatagaatgtattttaagaaatctatacaaattggatatatgcttggtaattctccagtttctaggaggtacctatttctaccgtttcaagtgatgaagtgaaaataatttacattcgatagtgttactgataacaaacctacttaagagatatgttgctttttacttaagggatagtgttgatagataaattagaatgtatagataggtttgtgaaagtctaaataatggttgtatagatatgtatatatggttcacatatctggatctgtgtatttgattttgtactttaaatgtgacaaataaaccttttgggaaaaaaaaaaaaa

SEQ ID NO: 436403 - DNA, 640 bp, Homo sapiens
aaaaaaaagtcatttttgtgtacttcttttaaagccatctaaaactcatttttgagagagaggagccaatttagagatgtaaagacttttcaaatttcatgtatagcaagcccctcttaaagagaactattaatacatgaaaataagcatgtccccctctttcccataccctcctactcctttggtgtggctccgtggctcttcatgtgaacattcatttggttctagcatatactaacctattctgcatctccatctaaatgccaataaatgttttttggtcagtggaagttttatgatttgcttttaaagaggatatcatgctatttttctttttgtatgtttacagaatcaccttaaagatatactgacgtcagttgtgtcaagaaggaaagcttatcggttacgagatggtcattttaaatatgcctttggcagtaacgtgaccccgcagccatacctgaagaatagtgtagtagcttacaacaacttaatagaaaggtaaatgaagtttcttgtgattttctttccatcttttgctagttgtttatactcctcttatagaccattgttaaataattgattgtgttttcataggtttaagtacctttaataggagtacaattttattttttaaagt

SEQ ID NO: 436404 - DNA, 2679 bp, Homo sapiens
ggaggaagagagcagagtttggccgggcaccttccctgcgaaaaggcgggcggagccgaaaaccaaacaaacgacttctgagagattgggggcgggactgacggcggccggcttagcttccagagccaaggccttccgccgagttggtttttgggttgttgatcgcggtggccgggcggtctgcggtcgggctgagacacgcggagcaatggcgacctttgtgagcgagctggaggcggccaagaagaacttaagcgaggccctgggggacaacgtgaaacaatactgggctaacctaaagctgtggttcaagcagaagatcagcaaagaggagtttgaccttgaagctcatagacttctcacacaggataatgtccattctcacaatgatttcctcctggccattctcacgcgttgtcagattttggtttctacaccagatggtgctggatctttgccttggccagggggttccgcagcaaaacctggaaaacccaagggaaagaaaaagctttcttctgttcgtcagaaatttgatcatagattccagcctcaaaatcctctctcaggagcccagcaatttgtggcaaaggatccccaagatgatgacgacttgaaactttgttcccacacaatgatgcttcccactcgaggccagcttgaagggagaatgatagtgactgcttatgagcatgggctggacaatgtcaccgaggaggctgtttcagctgttgtctatgctgtggagaatcaccttaaagatatactgacgtcagttgtgtcaagaaggaaagcttatcggttacgagatggtcattttaaatatgcctttggcagtaacgtgaccccgcagccatacctgaagaatagtgtagtagcttacaacaacttaatagaaagccctccagcttttactgctccctgtgctggtcagaatccagcttctcacccaccccctgatgatgctgagcagcaggctgcactcctgctggcatgctccggagacactctacctgcatctttgcctccggtgaacatgtacgatctttttgaagctttgcaggtaagtcttggctccttaaagtttacctaggtttatggataggttaagagattctttaagtctacaaaggtattcactggttttttccacttcttggctttgtgtttttcagttttgtctgttataaaagccgttattaatactagcctcatttttcaaatcctgagcccatcttctatctccccaataaagaaagaaaagaaaaaaaatcccttgttctgctattcctgtttcagaagcttgttatttccttattattatccaattggtgattcattttagtgtatgactgaaagtttatagattgtgtgtatgttttgttgatataaacccttttatatgtcagaaaaataagtctactcaagtataattggacatgcgttaattttttaatcccaggtgcacagggaagtcatccctacacatactgtctatgctcttaacattgaaaggatcatcacgaaactctggcatccaaatcatgaagagctgcagcaagacaaagttcaccgccagcgcttggcagccaaggaggggcttttgctgtgctaaattaggatttgagggtgtgggaccctcaccgaattcattgattactgaaaattgaatgttttttgggtccacatttcaaggctgaagtgtatagtgtatatataacctttcctatggaaatgtgacattgagtacattttgtgttgctgttgtgaagccattaatataaatctttggtaatgacccatatctctatatgtatgtgttcccagttgtgggagcaggcactaatgaaatcctgtgcctggaatggagatatttaggtacctgaggcttagtgtcctgtggtctgcatgtaagatagatgacatcctagaacaaagaagctgttttaacttaatccccctgatcagcaggatatctgtgtgttcagtgacatcatacattctgtatctagaagtctaaaatttctgcctttctcctaaagaatgtgttcttgcattttggttgaaataacctacacagtgttaaaaatcagatacctcctttagtgaccagttcaaattttaatagcgataggtagcccctgagaaatttatcactataactccacaggaaatatgacttggaagtgctctgtgtactaaacaaaataaagcccctctttgcatttaaaaccaaagtcaaaacaaaactcttgtaatgcaattaattaactttatgtcttcccatgactcaagttttgttaaatatgcccaaaaactttgattggcagtttcttcggttaattattcctatagaatgtattttaagaaatctatacaaattggatatatgcttggtaattctccagtttctaggaggtacctatttctaccgtttcaagtgatgaagtgaaaataatttacattcgatagtgttactgataacaaacctacttaagagatatgttgctttttacttaagggatagtgttgatagataaattagaatgtatagataggtttgtgaaagtctaaataatggttgtatagatatgtatatatggttcacatatctggatctgtgtatttgattttgtactttaaatgtgacaaataaaccttttgggaaaaaaaaaaaaa

SEQ ID NO: 436405 - DNA, 3108 bp, Homo sapiens
gacgtaagatgctttatttgtaatatatttagattttgaaagttattgagagatgaatgtataaaagctaaattttcttttctgaagcagtgaaacaaaattggggtaacaaggaagctctgttgtggcaaacatgtctatgaggaatattaaaactaagcatactcccacaggctttaaactcaaactatgaacatttaaattaagttgttccttattttgcctatacccatttttatctttcattgtcgtttttgcttgacagtatggtgacagagtatttttatttggaaagtcctcagcaagatgaattagccaaaagcaataatggttcagattaaacaataaagtggaattgattcaatcccaggctcaactaagaacagtcgctctctggatctttcattttagacgatagataagttgagatgttgtaatatttatggggggttaagcctgtgtcagttatgggatgaagacttgtagtaccagtaccatcagtggtcatacttttttttaactttttactaaactaatacagttagacatttccactctatcgtgattatatttttatgatgggaaaataaaaacacttccatgtttttataaatagtctctgcaaagatttcagatgttattggtatctcggtttggcagtatctgaaaaattgagattgtctttgaaatgtttgtgctacttttacttaagtaaacccccactgtgcaagacccaggccggcttcagctaataccaaggtttctgtgtgcataatagtttacagagaacttaagagtaaggactgcggattaaaaacaaaactttttttaactttaaaatttttagtttttgttcaaagtacctgggtttataaagtcaaattcttttattagttcctttctcgtttaaattgactgatgttgctgatgaagcttaaagtcccaggcacggttgtggcgatatactgataaaattggtgcctagtggtgggaggagctccagtgtcaggacttttattaaaaggcccttgttttcccaaatgccaatctagccacatttagatttcattattcaataaaacagatgaaaaatcatcccataaatgaatgttgaggttaccaaagtacatcacctgctgaggaaggataaatcttcctgctttaagggagccctgtcatctctcctcttaatgcacgtttcccttggtattagtggaagctgtgttcaagatgggaagcctttcctgcagttcttagaaacacctgctttctaaggagagccttttctaggattagcttatgtgtgttttctctaggcgattttttatttcagttaccaatttaattttcaagttgacagatgctgtgtaaagtctctcataatgagagtagtccattaaattgttgaaagttgcactgcttttcatctttcaggtacctgaaatgagtgacatcaggtatttggaaggagtaagatcataaactgtattcattttcttccttgtacaaagtgatgacttctaatgcttatatctcaaggtattttttaaaaaagcaacggtccctaatagagtaaaatttggttttggtccaagttcccaataatgtatttaatgtttctgttgtttactggtgcctcccgttgcatcaggtagagattgcctgcctctttgtagggcagccttgtggcaccttatgtccaacttggaggatagtatatggcttctttgtgcctctactatcttttcaaaagccattttataaaaatcctaggtagcctattttaatatttaaatatatatatttgtgaaagaacttttagaacagaccttttctttttactttaaaattcctgtatttccatttttaagagtaaatttaatctccaggatttagaagtgtctttccagagaagcataatgagaaagtcagactgaggtaataagaccagaattaagtgatagaagaaactgttgtttggttaaaggacacagatttgaaggaaaaaaattttgatgtaacaattttttaaataaaattttgtttttctgtaatgtcatatttgctgctacagtagctcaatattttacagggctaacataaagctggctccatttaaaaactggagtacttcctagtgcagccagcctaggcggaaactgtacaccatggtcttccagatgggtgactgatggctttgggtagctgatgcatgctttaatatttgcctatagcccggcagcaaggaagtcggggcggggggacttttttaccctgccagttatagcattgtgattctttctgggcactggcattttgtgaaactctcaagggaaggtgatgcaggggagaaaatgtgaattaaattacatagatgggtgtttttatgtcttctacccctttcctagaattagtacaactcttaactgtgccagtccccagttcaccagctttgtatccagtcgtcatctcattcaagtatggctttacttggtgacactggccatagctaagttaacttggcatgtttgacttttgacaataacaaaaatggttttggatttgttttatttccaaaaaatgtatacaatatcagaacttcacattttatatactagtatctggctattagtattttacaggaaccatagttcttggtgactacatatatatatatatttttgtgaccttttttgtaaactaagtgccgtttcaacgttacaatcatttttagggttattgtaatcaatgtgaatatcatgttttttcaaatctgttctgagcctatagtgtttgctttgtgaacatgtgtattgtatatattctgtatagttatattgtactgaaattagcttgtttgatataaggaaaatatgtattgagtacctttttgctagcctgattgtttaatctttttaaaaaaggtttaaactttttttaaaaaaaaaatctttaaactggcctttattacatggtcacacataaagttgcagttaggaaagggatgggcagggaaaaactagttttgagtgtctttagatagaaacatgagactaaggtttgattttgttttcgttttctcattaaaatatcttatgctttatggaa

SEQ ID NO: 436406 - DNA, 3054 bp, Homo sapiens
gacgtaagatgctttatttgtaatatatttagattttgaaagttattgagagatgaatgtataaaagctaaattttcttttctgaagcagtgaaacaaaattggggtaacaaggaagctctgttgtggcaaacatgtctatgaggaatattaaaactaagcatactcccacaggctttaaactcaaactatgaacatttaaattaagttgttccttattttgcctatacccatttttatctttcattgtcgtttttgcttgacagtatggtgacagagtatttttatttggaaagtcctcagcaagatgaattagccaaaagcaataatggttcagattaaacaataaagtggaattgattcaatcccaggctcaactaagaacagtcgctctctggatctttcattttagacgatagataagttgagatgttgtaatatttatggggggttaagcctgtgtcagttatgggatgaagacttgtagtaccagtaccatcagtggtcatacttttttttaactttttactaaactaatacagttagacatttccactctatcgtgattatatttttatgatgggaaaataaaaacacttccatgtttttataaatagtctctgcaaagatttcagatgttattggtatctcggtttggcagtatctgaaaaattgagattgtctttgaaatgtttgtgctacttttacttaagtaaacccccactgtgcaagacccaggccggcttcagctaataccaaggtttctgtgtgcataatagtttacagagaacttaagagtaaggactgcggattaaaaacaaaactttttttaactttaaaatttttagtttttgttcaaagtacctgggtttataaagtcaaattcttttattagttcctttctcgtttaaattgactgatgttgctgatgaagcttaaagtcccaggcacggttgtggcgatatactgataaaattggtgcctagtggtgggaggagctccagtgtcaggacttttattaaaaggcccttgttttcccaaatgccaatctagccacatttagatttcattattcaataaaacagatgaaaaatcatcccataaatgaatgttgaggttaccaaagtacatcacctgctgaggaaggataaatcttcctgctttaagggagccctgtcatctctcctcttaatgcacgtttcccttggtattagtggaagctgtgttcaagatgggaagcctttcctgcagttcttagaaacacctgctttctaaggagagccttttctaggattagcttatgtgtgttttctctaggcgattttttatttcagttaccaatttaattttcaagttgacagatgctgtgtaaagtctctcataatgagagtagtccattaaattgttgaaagttgcactgcttttcatctttcaggtacctgaaatgagtgacatcaggtatttggaaggagtaagatcataaactgtattcattttcttccttgtacaaagtgatgacttctaatgcttatatctcaaggtattttttaaaaaagcaacggtccctaatagagtaaaatttggttttggtccaagttcccaataatgtatttaatgtttctgttgtttactggtgcctcccgttgcatcaggtagagattgcctgcctctttgtagggcagccttgtggcaccttatgtccaacttggaggatagtatatggcttctttgtgcctctactatcttttcaaaagccattttataaaaatcctaggtagcctattttaatatttaaatatatatatttgtgaaagaacttttagaacagaccttttctttttactttaaaattcctgtatttccatttttaagagtaaatttaatctccaggatttagaagtgtctttccagagaagcataatgagaaagtcagactgaggtaataagaccagaattaagtgatagaagaaactgttgtttggttaaaggacacagatttgaaggaaaaaaattttgatgtaacaattttttaaataaaattttgtttttctgtaatgtcatatttgctgctacagtagctcaatattttacagggctaacataaagctggctccatttaaaaactggagtacttcctagtgcagccagcctaggcggaaactgtacaccatggtcttccagatgggtgactgatggctttgggtagctgatgcatgctttaatatttgcctatagcccggcagcaaggaagtcggggcggggggacttttttaccctgccagttatagcattgtgattctttctgggcactggcattttgtgaaactctcaagggaaggtgatgcaggggagaaaatgtgaattaaattacatagatgggtgtttttatgtcttctacccctttcctagaattagtacaactcttaactgtgccagtccccagttcaccagctttgtatccagtcgtcatctcattcaagtatggctttacttggtgacactggccatagctaagttaacttggcatgtttgacttttgacaataacaaaaatggttttggatttgttttatttccaaatattttacaggaaccatagttcttggtgactacatatatatatatatttttgtgaccttttttgtaaactaagtgccgtttcaacgttacaatcatttttagggttattgtaatcaatgtgaatatcatgttttttcaaatctgttctgagcctatagtgtttgctttgtgaacatgtgtattgtatatattctgtatagttatattgtactgaaattagcttgtttgatataaggaaaatatgtattgagtacctttttgctagcctgattgtttaatctttttaaaaaaggtttaaactttttttaaaaaaaaaatctttaaactggcctttattacatggtcacacataaagttgcagttaggaaagggatgggcagggaaaaactagttttgagtgtctttagatagaaacatgagactaaggtttgattttgttttcgttttctcattaaaatatcttatgctttatggaa

SEQ ID NO: 436407 - DNA, 2129 bp, Homo sapiens
  misc_feature (2008)..(2008): n is a, c, g, or t
  misc_feature (2018)..(2018): n is a, c, g, or t
  misc_feature (2020)..(2021): n is a, c, g, or t
  misc_feature (2038)..(2039): n is a, c, g, or t
  misc_feature (2066)..(2066): n is a, c, g, or t
gacgtaagatgctttatttgtaatatatttagattttgaaagttattgagagatgaatgtataaaagctaaattttcttttctgaagcagtgaaacaaaattggggtaacaaggaagctctgttgtggcaaacatgtctatgaggaatattaaaactaagcatactcccacaggctttaaactcaaactatgaacatttaaattaagttgttccttattttgcctatacccatttttatctttcattgtcgtttttgcttgacagtatggtgacagagtatttttatttggaaagtcctcagcaagatgaattagccaaaagcaataatggttcagattaaacaataaagtggaattgattcaatcccaggctcaactaagaacagtcgctctctggatctttcattttagacgatagataagttgagatgttgtaatatttatggggggttaagcctgtgtcagttatgggatgaagacttgtagtaccagtaccatcagtggtcatacttttttttaactttttactaaactaatacagttagacatttccactctatcgtgattatatttttatgatgggaaaataaaaacacttccatgtttttataaatagtctctgcaaagatttcagatgttattggtatctcggtttggcagtatctgaaaaattgagattgtctttgaaatgtttgtgctacttttacttaagtaaacccccactgtgcaagacccaggccggcttcagctaataccaaggtttctgtgtgcataatagtttacagagaacttaagagtaaggactgcggattaaaaacaaaactttttttaactttaaaatttttagtttttgttcaaagtacctgggtttataaagtcaaattcttttattagttcctttctcgtttaaattgactgatgttgctgatgaagcttaaagtcccaggcacggttgtggcgatatactgataaaattggtgcctagtggtgggaggagctccagtgtcaggacttttattaaaaggcccttgttttcccaaatgccaatctagccacatttagatttcattattcaataaaacagatgaaaaatcatcccataaatgaatgttgaggttaccaaagtacatcacctgctgaggaaggataaatcttcctgctttaagggagccctgtcatctctcctcttaatgcacgtttcccttggtattagtggaagctgtgttcaagatgggaagcctttcctgcagttcttagaaacacctgctttctaaggagagccttttctaggattagcttatgtgtgttttctctaggcgattttttatttcagttaccaatttaattttcaagttgacagatgctgtgtaaagtctctcataatgagagtagtccattaaattgttgaaagttgcactgcttttcatctttcaggtacctgaaatgagtgacatcaggtatttggaaggagtaagatcataaactgtattcattttcttccttgtacaaagtgatgacttctaatgcttatatctcaaggtattttttaaaaaagcaacggtccctaatagagtaaaatttggttttggtccaagttcccaataatgtatttaatgtttctgttgtttactggtgcctcccgttgcatcaggtagagattgcctgcctctttgtagggcagccttgtggcaccttatgtccaacttggaggatagtatatggcttctttgtgcctctactatcttttcaaaagccattttataaaaatcctaggtagcctattttaatatttaaatatatatatttgtgaaagaacttttagaacagaccttttctttttactttaaaattcctgtatttccatttttaagagtaaatttaatctccaggatttagaagtgtctttccagagaagcataatgagaaagtcagactgaggtaataagaccagaattaagtgatagaagaaactgttgtttggttaaaggacacagatttgaaggaattntgatgtacantnntttatgctgctcattannactgagtcttctagtcagcagctagcngactgtcacatgcttcagatgtactgtgcttggtactatgctgctatattctatgccgagcag

SEQ ID NO: 436408 - DNA, 746 bp, Homo sapiens
atgaaatgaatgatcatcaaagtaccctctcctacatcctgattaacccatctccagataccagaatagagctgaatgatgttgtatacttaattcgaccagatccactggcctaccttccaaacagtgagcccagtcgaagaaacagcatctgcaatgtcactggtcaagattctcgggaggaaactcaactttgataaaaataaaatgagaaacttttttcctacaaagaccttgcttgaaaccacaaaagttttgctggcacgaaagaaactagatggaaatatatgtaattctctcatatttaaaaacgtaatctcttctcttagaagtatagatcattttgaaacttaatgtactacttactggtactctccctattaatatttgaaggacctcaatggaataaatttgaaaagctaaattaaaatacaaaaatttaaatctgacatttaattgttttataataatccaaactctatgaaagcaattttaaaaattattaaggttttatgaagttgacaaaatctaactatatttggtgcatcacaatgggacacaggaatgctgctgctcctcttaaaaattaaatgtgtcatattatattctttaaacttactgttttacaaaattgagctcatcgtaaatgtctaggtcttctcacatggaggtttacccacaacctgtgtgggcctgacttttgtgtaagaatcatagtttgctttagaatacaaatctttaagtca

SEQ ID NO: 436409 - DNA, 1301 bp, Homo sapiens
ttaagaaattctggtggattggagcccctggtagagctgctacgctccaagaatgatgaagtgaggaagcacgccagttgggcagtgatggtctgtgctggtgacgagctgacggccaatgaattatgcaggctcggggctttagatatccttgaagaagttaacgtatcaggaactcggaaaaataaattcagtgaggcagcttataataagttgctcaataacaatctttccctgaaatacagccagactggctatttgtcatcaagtaacataattaacgatggattctatgattatggtcggataaatcccggcaccaaactgttgcctttgaaggagctctgcttacaagaaccaagtgacctacgggctgtactcttaatcaacagtaaatcttacgtttctccaccttcatctatggaagataaatcagatgttggttatggacgaagtatttcttcttcatcttccttaagaagatcaagtaaagaaaagaataaaaaaaatagttatcattttagtgctggatttggatctcccatagaagacaaatcagagccagcttctggacgaaatactgttctcagcaaaagcgccaccaaagaaaaaggatggaggaaaagcaaaggaaaaaaagaagaggaaaaagtgaaagaggaggaagaggttatggtggtaccaaaatttgttggtgaaggaagctctgacaaagaatggtgtcctccctctgaccctgatttctctatgtatgtgtatgaggtgaccaaatcaatactgccaataaccaatattaaggaacagattgaggatctggcaaagtatgtagcagaaaaaatgggtggtaagattccaaaagagaaactacctgatttcagctgggaacttcacataagtgaactgaaatttcaacttaaatccaatgttataccgattggacatgtcaaaaaaggaatcttctaccatcgagctttgcttttcaaggctctggctgatagaattggcattggttgctccctagttcgcggagagtacggtagagcgtggaatgaagtcatgctgcagaatgactctcggaagggagtgattgggggcctccccgctcctgagatgtacgtgattgacctcatgttccatccaggtggactgatgaagttgagaagtcgagaggctgatctttacagattcatttaagccatcagacgaacacaagagaggctcaaacaagaaattcactgtgtacactctctaagacattctccaaattgattttatctctttaaataaaaactttaaataaa

SEQ ID NO: 436410 - DNA, 1064 bp, Homo sapiens
ttaagaaattctggtggattggagcccctggtagagctgctacgctccaagaatgatgaagtgaggaagcacgccagttgggcagtgatggtctgtgctggtgacgagctgacggccaatgaattatgcaggctcggggctttagatatccttgaagaagttaacgtatcaggaactcggaaaaataaattcagtgaggcagcttataataagttgctcaataacaatctttccctgaaatacagccagactggctatttgtcatcaagtaacataattaacgatggattctatgattatggtcggataaatcccggcaccaaactgttgcctttgaaggagctctgcttacaagaaccaagtgacctacgggctgtactcttaatcaacagtaaatcttacgtttctccaccttcatctatggaagataaatcagatgttggttatggacgaagtatttcttcttcatcttccttaagaagatcaagtaaagaaaagaataaaaaaaatagttatcattttagtgctggatttggatctcccatagaagacaaatcagagccagcttctggacgaaatactgttctcagcaaaagcgccaccaaagaaaaaggatggaggaaaagcaaaggaaaaaaagaagaggaaaaagtgaaagaggaggaagaggttatggtggtaccaaaatttgttggtgaaggaagctctgacaaagaatggtgtcctccctctgaccctgatttctctatgtatgtgtatgaggtgaccaaatcaatactgccaataaccaatattaaggaacagattgaggatctggcaaagtcatacgttcactaagaatcagagatagcagctggaaattgcttcaagaaaaatgcctgtcattttcttcagctagaccatgaaaagcatctttcaatgtgatcctgcagaagttatgaatgaatcaaaagtttgaagattaaatcatcccttaggtggatggggtgttcataagttaaaggaatcctactgtgaattatttgtaaactgataaattttctaatacaaatgtccaatgtctc

SEQ ID NO: 436411 - DNA, 361 bp, Homo sapiens
caaagaatggtgtcctccctctgaccctgatttctctatgtatgtgtatgaggtgaccaaatcaatactgccaataaccaatattaaggaacagattgaggatctggcaaagtaagttgtctatgtatatatgtgtttttaatttctgaaaaaattttagtgtcatatacattttagccatgttttagacaaatacaccataaataaaattgaagtttacagcactctgactctgacacagaaacacaatgaattggaaaagtcctcaacttctatttaggtcatacgttcactaagaatcagagatagcagctggaaattgcttcaagaaaaatgcctgtcattttcttcagctagacca

SEQ ID NO: 436412 - DNA, 1010 bp, Homo sapiens
ttaagaaattctggtggattggagcccctggtagagctgctacgctccaagaatgatgaagtgaggaagcacgccagttgggcagtgatggtctgtgctggtgacgagctgacggccaatgaattatgcaggctcggggctttagatatccttgaagaagttaacgtatcaggaactcggaaaaataaattcagtgaggcagcttataataagttgctcaataacaatctttccctgaaatacagccagactggctatttgtcatcaagtaacataattaacgatggattctatgattatggtcggataaatcccggcaccaaactgttgcctttgaaggagctctgcttacaagaaccaagtgacctacgggctgtactcttaatcaacagtaaatcttacgtttctccaccttcatctatggaagataaatcagatgttggttatggacgaagtatttcttcttcatcttccttaagaagatcaagtaaagaaaagaataaaaaaaatagttatcattttagtgctggatttggatctcccatagaagacaaatcagagccagcttctggacgaaatactgttctcagcaaaagcgccaccaaagaaaaaggatggagctcactccccacttcaagataaaccctgaagcactcctaggatttaagaggattgttggcatgaggagaacacagagactttggattcagacacaactgggccttggtcttctgaattgtaaatgaaaatgatgatccctgcctcaaagagctgctgtaagaggagagatggtgtcaggaaagtgcctgaccatcacctagcacacttaggggctcaatgtgcgacccttctctcttcccttcttagcctttggtccattgaggggtagattagccatagccctgttgtcctgttgcctgtcttttggtcaacccttcttgtcttatgactattaaaactttggactcctggaaatagaataaaatattttaactgcattcgtctgaaaa

SEQ ID NO: 436413 - DNA, 474 bp, Homo sapiens
aaaagcgcctaggtgttgctgacctttaaacagccttaaagctgtgaagttgcaagtgatgatgtttgtgttattctcgggtcttggttttggttattaagtcaaggaattgatacattatgtatatcatgtagatagacatacattctttgtatctttcgatttttaggggggatagaatactgggagcagaggcggagtggcaactttaaacaggtggaagccaagctaattgacaaactggatagcctgatgtcagaaggcaaaggtgacgaaacataccgcgagctcttcaacagtattctactaaagaaaattgagcgggaaacatggcgggaaagtggcgtttcattaattgctactgtaactcgtctaatggagaggttgttagattacagggactgcatgaaaatgggagaggtagatggcaaaaagattggctgcacagttagccttctgaacttctataagact

SEQ ID NO: 436414 - DNA, 5385 bp, Homo sapiens
atctgggattcctacttttacctcgcagtcatttttataaaccagttgtgtctgcagttggagatgttcacaccttccaagaagaaaaaggtgttagaaaagtatggtgacatgcgggtaacaatgggttgtgaaattttcagcatgtggcaaaacctaggagagcacaagcttcattttatccctgccctgattggccccttcctagaagtgaccttgataccccagccagatcttcggaatgtcatgattccaatttttcatgatatgatggactgggagcagaggcggagtggcaactttaaacaggtggaagccaagctaattgacaaactggatagcctgatgtcagaaggcaaaggtgacgaaacataccgcgagctcttcaacagtattctactaaagaaaattgagcgggaaacatggcgggaaagtggcgtttcattaattgctactgtaactcgtctaatggagaggttgttagattacagaacttctataagactgaactgaacaaggaggagatgtatatacgctacattcacaaactctatgatctgcatctcaaagcacagaactttacagaagctgcatataccctcctcttatatgacgagctactggaatggtctgatcggcccctcagggagttcctgacctaccccatgcaaacagaatggcagcgcaaagagcacctgcacctcaccatcatccagaactttgacagaggcaaatgttgggagaatggcattatcttgtgccggaagattgcagagcagtatgagagttattatgactacagaaacctgagcaagatgcggatgatggaagcctctttgtatgacaaaattatggaccagcaacgtcttgaaccagagttcttcagagttggattttatggaaaaaaatttccatttttcttaagaaataaggagtttgtgtgtcgagggcatgactacgagaggctggaagccttccaacagagaatgctgaacgagttcccccatgccatcgccatgcagcacgccaaccagcccgatgagaccatcttccaggcagaagctcagtatttgcagatatatgctgtgactcccattccagagagccaggaggtcctgcagagagagggtgttccggacaacatcaaaagcttctataaagtgaatcacatctggaaattccgctatgaccgaccatttcacaaaggcacaaaagataaagagaatgaattcaagagtctctgggtggagagaacgtcattatacttggtgcagagtttgcctggcatctctcgctggtttgaagtggaaaagcgtgaagtggtagaaatgagtcctctggaaaatgcaattgaagtgctagaaaataagaatcagcagctgaagactctgattagtcagtgtcagacaagacagatgcagaatattaatcccctgactatgtgcctgaatggagttatagatgctgcagttaatggtggcgtttccaggtatcaagaggcattctttgtcaaagaatatatcttaagtcaccctgaagatggggagaaaattgcacgattaagagagctgatgcttgagcaggcacagattctggaatttggtttggccgtgcatgagaagtttgtacctcaagatatgagaccccttcacaaaaagctggttgaccaattctttgtgatgaagtcgagcttagggatacaggagttctctgcttgtatgcaagccagtcctgtccattttcctaatggaagccctcgtgtgtgtagaaactcagcacctgcttctgtgagcccagatggtaccagggtaattcctagacgcagcccgttaagttacccagctgtcaaccgatattcttcctcctcactgtcctcacaagcttctgctgaagtaagcaatattacagggcaatcagaaagctctgatgaagtctttaacatgcagccaagtccatctacctcaagcttgagttctactcactcggcttcacctaatgtgacaagttctgctccatcgagtgccagagcttctcctttgttgtctgacaaacacaaacattcccgagaaaactcttgcctgtcaccaagagagagaccatgcagtgccatctatccaacacctgtggagccttcgcagaggatgctgtttaatcatattggagacggggccttgccacgcagtgacccaaatctctctgcacctgaaaaagcttcaccagcaagacacacgacatcagtatccccctcgcctgccgggcgatctccattgaagggctctgtgcagtctttcaccccctctccagtggagtaccactcgccaggactcatctccaactcccctgtcttgtcgggcagctacagcagtgggatttcttctctcagccggtgcagcacgtcggaaacctcaggctttgaaaatcaggtgaatgaacagtcggcccccctgccggtgccagtgccggtgcccgtgccgagctacggcggggaggagccagtgcgcaaggagagcaagactccgcccccgtacagcgtctacgagcggactctgcggcgccccgtcccgctacctcacagcctctccatccccgtcacgtcggagccgcccgcgctgccccccaagcctctggcagcgcgatccagccacctggagaatggggcccggaggactgaccccggcccgcggcccaggcccctgccccgcaaggtctctcagttataagtcacttttctatgtacctgcgatgcattctttgcccgtttacaaaataagaagtatgatgagaagacatttagtgtaggcactttaataacttactcagctccttcgatgaatggaattaaaacttgcttattaaatatcatgttgcacaatattaaaagttgctgatctaaaacgccagatgttaaatgaagtatggctgaatttcattaaaacgtttctcatttggaagtggtaaatagtgataaagactccttttgtacctttttatgttcacttttttttatatagtttaatcttaaaaccaatacgatattgtcaaacgatacaatgtgtgacaatgttgtatcgtttttactgaatacttgatacttggagaaagcttattaagtcagtgcacatcctaacacagtggtccttattttagaagacttctgtaaataaggcaaggtttatcagtgcagatcatcagaattaaagttcaagcaggcgagcaagacagtatacttaaggggttgcaaagcttgggactggaaattgttttgttcttgaaacaaaatacttctttaaggttgcttttgctgtttgactgctgtctacattcgtaaaattctattttgtgaattggtagctaaatcccttactaccctgacaccgtggtatctactgtatttcttttcaaggtgcaatttgcttcagagttccaatcagctagattaagcaagaggctccagaagaaatgtttacttgaattttgcgcttcctttcttgatagtttcctatataaaatttgtcattgaacaagagcaaatgctgaagtattaatgaggcacaaatgactgtgccccattagcaagaattcaggaatcaatacagacagtattaaattaatagcttaagtgaagaaaaaaaaaacttagtgaaaatgtattagcacgattaaatggcaaaaggacttataaaaggcaagggcattaactttcagtcctgcacaaaataaaaaattcctcacgactctccacttttaccagtggagtttgtcttagctgacctgtcgtctttctcttgaaggaggattgctgtagacttctctagcttgaatattgcaacatagcatcttaggtctagatagggatgctaatgccagttgtagaagtgtgaaaaaagcaccttgtatgtagtaatgtattttatatctttgttttttcttttactgactgtttataacactcaattgacaatagatatgaactgtattttaaatcatactgttaaatattttccctcttttgttgggaagctcattttagtttaaccatgtttgttttgttggtagcttacctggaaggcagtgaccacttttttatattctcttaatgaaaccattcagcaggtatatgctgttgaggctggttatagaggttttctataataaatgttcaagtatttttgtatataactggttaattttaataagagataccattatgtgtaaaaaaaagtaaaaataaacgcaaacagttgttgatgcagtatgattgttataattatgccaaatactttacgtatggaaaaagaatatttgtacatatgtgcttttaacaattctgccatattgactttacaattttgaatgtcggaaaaattaatatatgttaaatatttatgtttagtgaaagtgttcataattgagaaaaggaacatatgcattttagctttgtatcttgcaagttttgcagtcagaaattttttgaactagcttttgcttttgataacacttcgtgtttgtaaccacattcatatatatatacatatatatgtgaagctccatatttctgttgctttaaagaagtaaaaccttccatttaaataagatgacatgcataagataacaaagcttccttgatttccttttcctgtgtaatttaatagatttgttgactagtgcttgggcacattataaatcagtgttatttgctcttggagccattttttaaaaaaaattttggcagtgagcagttgaatttatcttgaatttatcatgtgtgtgtatttctgaagcagctacatagcagaacattttaagagattctgttagcccacatgttcatgttggttgctgctgaatggtaaatattaaataaaattaccagattaatcttaatatttctgtctttactcctatcatcagcatgtctttacttgtaatagaagcggctcttgatcttattatagtgagatttccagacttctttttagatagatcctgtttgtgttgtcctgccacgtagatgcatttcacactcactacggctcacttatgccatagggaacaatcaccagaaaggtaacaaacagtatgggttaatatcccatagaaagggtaacatttacctggttggctgaccattcattggcctaaccagagccaacttaacaagtcaaaccatcaaaatgtgtttgcatcagaaaacttgacataaaacagataacttccaagcatataagggcatggttaaatgctggttttgacagctgtggtaaaaatctatctgcatgccaactcttctccctggttttcataaaatgatagaaaatatacatgtgacatacactgaaaaacccactgactacaagatttctattaataaagcctggcttttaa

SEQ ID NO: 436415 - DNA, 2477 bp, Homo sapiens
atctgggattcctacttttacctcgcagtcatttttataaaccagttgtgtctgcagttggagatgttcacaccttccaagaagaaaaaggtgttagaaaagtatggtgacatgcgggtaacaatgggttgtgaaattttcagcatgtggcaaaacctaggagagcacaagcttcattttatccctgccctgattggccccttcctagaagtgaccttgataccccagccagatcttcggaatgtcatgattccaatttttcatgatatgatggactgggagcagaggcggagtggcaactttaaacaggtggaagccaagctaattgacaaactggatagcctgatgtcagaaggcaaaggtgacgaaacataccgcgagctcttcaacagtattctactaaagaaaattgagcgggaaacatggcgggaaagtggcgtttcattaattgctactgtaactcgtctaatggagaggttgttagattacagaacttctataagactgaactgaacaaggaggagatgtatatacgctacattcacaaactctatgatctgcatctcaaagcacagaactttacagaagctgcatataccctcctcttatatgacgagctactggaatggtctgatcggcccctcagggagttcctgacctaccccatgcaaacagaatggcagcgcaaagagcacctgcacctcaccatcatccagaactttgacagaggcaaatgttgggagaatggcattatcttgtgccggaagattgcagagcagtatgagagttattatgactacagaaacctgagcaagatgcggatgatggaagcctctttgtatgacaaaattatggaccagcaacgtcttgaaccagagttcttcagagttggattttatggaaaaaaatttccatttttcttaagaaataaggagtttgtgtgtcgagggcatgactacgagaggctggaagccttccaacagagaatgctgaacgagttcccccatgccatcgccatgcagcacgccaaccagcccgatgagaccatcttccaggcagaagctcagtatttgcagatatatgctgtgactcccattccagagagccaggaggtcctgcagagagagggtgttccggacaacatcaaaagcttctataaagtgaatcacatctggaaattccgctatgaccgaccatttcacaaaggcacaaaagataaagagaatgaattcaagagtctctgggtggagagaacgtcattatacttggtgcagagtttgcctggcatctctcgctggtttgaagtggaaaagcgtgaagtggtagaaatgagtcctctggaaaatgcaattgaagtgctagaaaataagaatcagcagctgaagactctgattagtcagtgtcagacaagacagatgcagaatattaatcccctgactatgtgcctgaatggagttatagatgctgcagttaatggtggcgtttccaggtatcaagaggcattctttgtcaaagaatatatcttaagtcaccctgaagatggggagaaaattgcacgattaagagagctgatgcttgagcaggcacagattctggaatttggtttggccgtgcatgagaagtttgtacctcaagatatgagaccccttcacaaaaagctggttgaccaattctttgtgatgaagtcgagcttagggatacaggagttctctgcttgtatgcaagccagtcctgtccattttcctaatggaagccctcgtgtgtgtagaaactcagcacctgcttctgtgagcccagatggtaccagggtaattcctagacgcagcccgttaagttacccagctgtcaaccgatattcttcctcctcactgtcctcacaagcttctgctgaagtaagcaatattacagggcaatcagaaagctctgatgaagtctttaacatgcagccaagtccatctacctcaagcttgagttctactcactcggcttcacctaatgtgacaagttctgctccatcgagtgccagaggtcagtgccagagtgtggggaagactgagggtgcccagagaaccttctagtcctgggaactgtggccagctgccacacgttcaggctctcgcctccaaacaggtgcagcaccactaccatgctgatgatcctctctctccttctcttcccagcttctcctttgttgtctgacaaacacaaacattcccgagaaaactcttgcctgtcaccaagagagagaccatgcagtgccatctatccaacacctgtggagccttcgcagaggatgctgtttaatcatattggagacggggccttgccacgcagtgacccaaatctctctgcacctgaaaaagctgtgaaccccacccctagcagctggagcctggacagtgggaaggaagccaagaacatgtcggatagtgggaaacttatctctccccctgtccctccaagacccacacagactg

SEQ ID NO: 436416 - DNA, 5154 bp, Homo sapiens
gggagaagctaggaaaaaatgtctttgagctgtgagatgcttgtatattttgaaaatatgattatatgcatgtgtttgtattttatgacttggataatctgaaaatcaatttgctttgtcaatgcttcctggattagaattccactatttggtccctatcctagtctactaaagaaaattgagcgggaaacatggcgggaaagtggcgtttcattaattgctactgtaactcgtctaatggagaggttgttagattacagaacttctataagactgaactgaacaaggaggagatgtatatacgctacattcacaaactctatgatctgcatctcaaagcacagaactttacagaagctgcatataccctcctcttatatgacgagctactggaatggtctgatcggcccctcagggagttcctgacctaccccatgcaaacagaatggcagcgcaaagagcacctgcacctcaccatcatccagaactttgacagaggcaaatgttgggagaatggcattatcttgtgccggaagattgcagagcagtatgagagttattatgactacagaaacctgagcaagatgcggatgatggaagcctctttgtatgacaaaattatggaccagcaacgtcttgaaccagagttcttcagagttggattttatggaaaaaaatttccatttttcttaagaaataaggagtttgtgtgtcgagggcatgactacgagaggctggaagccttccaacagagaatgctgaacgagttcccccatgccatcgccatgcagcacgccaaccagcccgatgagaccatcttccaggcagaagctcagtatttgcagatatatgctgtgactcccattccagagagccaggaggtcctgcagagagagggtgttccggacaacatcaaaagcttctataaagtgaatcacatctggaaattccgctatgaccgaccatttcacaaaggcacaaaagataaagagaatgaattcaagagtctctgggtggagagaacgtcattatacttggtgcagagtttgcctggcatctctcgctggtttgaagtggaaaagcgtgaagtggtagaaatgagtcctctggaaaatgcaattgaagtgctagaaaataagaatcagcagctgaagactctgattagtcagtgtcagacaagacagatgcagaatattaatcccctgactatgtgcctgaatggagttatagatgctgcagttaatggtggcgtttccaggtatcaagaggcattctttgtcaaagaatatatcttaagtcaccctgaagatggggagaaaattgcacgattaagagagctgatgcttgagcaggcacagattctggaatttggtttggccgtgcatgagaagtttgtacctcaagatatgagaccccttcacaaaaagctggttgaccaattctttgtgatgaagtcgagcttagggatacaggagttctctgcttgtatgcaagccagtcctgtccattttcctaatggaagccctcgtgtgtgtagaaactcagcacctgcttctgtgagcccagatggtaccagggtaattcctagacgcagcccgttaagttacccagctgtcaaccgatattcttcctcctcactgtcctcacaagcttctgctgaagtaagcaatattacagggcaatcagaaagctctgatgaagtctttaacatgcagccaagtccatctacctcaagcttgagttctactcactcggcttcacctaatgtgacaagttctgctccatcgagtgccagagcttctcctttgttgtctgacaaacacaaacattcccgagaaaactcttgcctgtcaccaagagagagaccatgcagtgccatctatccaacacctgtggagccttcgcagaggatgctgtttaatcatattggagacggggccttgccacgcagtgacccaaatctctctgcacctgaaaaagcttcaccagcaagacacacgacatcagtatccccctcgcctgccgggcgatctccattgaagggctctgtgcagtctttcaccccctctccagtggagtaccactcgccaggactcatctccaactcccctgtcttgtcgggcagctacagcagtgggatttcttctctcagccggtgcagcacgtcggaaacctcaggctttgaaaatcaggtgaatgaacagtcggcccccctgccggtgccagtgccggtgcccgtgccgagctacggcggggaggagccagtgcgcaaggagagcaagactccgcccccgtacagcgtctacgagcggactctgcggcgccccgtcccgctacctcacagcctctccatccccgtcacgtcggagccgcccgcgctgccccccaagcctctggcagcgcgatccagccacctggagaatggggcccggaggactgaccccggcccgcggcccaggcccctgccccgcaaggtctctcagttataagtcacttttctatgtacctgcgatgcattctttgcccgtttacaaaataagaagtatgatgagaagacatttagtgtaggcactttaataacttactcagctccttcgatgaatggaattaaaacttgcttattaaatatcatgttgcacaatattaaaagttgctgatctaaaacgccagatgttaaatgaagtatggctgaatttcattaaaacgtttctcatttggaagtggtaaatagtgataaagactccttttgtacctttttatgttcacttttttttatatagtttaatcttaaaaccaatacgatattgtcaaacgatacaatgtgtgacaatgttgtatcgtttttactgaatacttgatacttggagaaagcttattaagtcagtgcacatcctaacacagtggtccttattttagaagacttctgtaaataaggcaaggtttatcagtgcagatcatcagaattaaagttcaagcaggcgagcaagacagtatacttaaggggttgcaaagcttgggactggaaattgttttgttcttgaaacaaaatacttctttaaggttgcttttgctgtttgactgctgtctacattcgtaaaattctattttgtgaattggtagctaaatcccttactaccctgacaccgtggtatctactgtatttcttttcaaggtgcaatttgcttcagagttccaatcagctagattaagcaagaggctccagaagaaatgtttacttgaattttgcgcttcctttcttgatagtttcctatataaaatttgtcattgaacaagagcaaatgctgaagtattaatgaggcacaaatgactgtgccccattagcaagaattcaggaatcaatacagacagtattaaattaatagcttaagtgaagaaaaaaaaaacttagtgaaaatgtattagcacgattaaatggcaaaaggacttataaaaggcaagggcattaactttcagtcctgcacaaaataaaaaattcctcacgactctccacttttaccagtggagtttgtcttagctgacctgtcgtctttctcttgaaggaggattgctgtagacttctctagcttgaatattgcaacatagcatcttaggtctagatagggatgctaatgccagttgtagaagtgtgaaaaaagcaccttgtatgtagtaatgtattttatatctttgttttttcttttactgactgtttataacactcaattgacaatagatatgaactgtattttaaatcatactgttaaatattttccctcttttgttgggaagctcattttagtttaaccatgtttgttttgttggtagcttacctggaaggcagtgaccacttttttatattctcttaatgaaaccattcagcaggtatatgctgttgaggctggttatagaggttttctataataaatgttcaagtatttttgtatataactggttaattttaataagagataccattatgtgtaaaaaaaagtaaaaataaacgcaaacagttgttgatgcagtatgattgttataattatgccaaatactttacgtatggaaaaagaatatttgtacatatgtgcttttaacaattctgccatattgactttacaattttgaatgtcggaaaaattaatatatgttaaatatttatgtttagtgaaagtgttcataattgagaaaaggaacatatgcattttagctttgtatcttgcaagttttgcagtcagaaattttttgaactagcttttgcttttgataacacttcgtgtttgtaaccacattcatatatatatacatatatatgtgaagctccatatttctgttgctttaaagaagtaaaaccttccatttaaataagatgacatgcataagataacaaagcttccttgatttccttttcctgtgtaatttaatagatttgttgactagtgcttgggcacattataaatcagtgttatttgctcttggagccattttttaaaaaaaattttggcagtgagcagttgaatttatcttgaatttatcatgtgtgtgtatttctgaagcagctacatagcagaacattttaagagattctgttagcccacatgttcatgttggttgctgctgaatggtaaatattaaataaaattaccagattaatcttaatatttctgtctttactcctatcatcagcatgtctttacttgtaatagaagcggctcttgatcttattatagtgagatttccagacttctttttagatagatcctgtttgtgttgtcctgccacgtagatgcatttcacactcactacggctcacttatgccatagggaacaatcaccagaaaggtaacaaacagtatgggttaatatcccatagaaagggtaacatttacctggttggctgaccattcattggcctaaccagagccaacttaacaagtcaaaccatcaaaatgtgtttgcatcagaaaacttgacataaaacagataacttccaagcatataagggcatggttaaatgctggttttgacagctgtggtaaaaatctatctgcatgccaactcttctccctggttttcataaaatgatagaaaatatacatgtgacatacactgaaaaacccactgactacaagatttctattaataaagcctggcttttaa

SEQ ID NO: 436417 - DNA, 3858 bp, Homo sapiens
tgaaggaatgcactgctaactggtacgaagtcacagtgtatagctgaatctaacacgaaggcattcctttggcaggagtcaaaatctcagacttttcattaattcatgcagacttctttgtcaatctaagttattaagattttctatattgttaaacggacttttttttgctaatttgaaaaaaagttgatgattttgtttcaaatacgtcagtgtcgcgggaagcctttaatcagggtatgataatagctccctgtgtgtttccagccaagtccatctacctcaagcttgagttctactcactcggcttcacctaatgtgacaagttctgctccatcgagtgccagaggtcagtgccagagtgtggggaagactgagggtgcccagagaaccttctagtcctgggaactgtggccagctgccacacgttcaggctctcgcctccaaacaggtgcagcaccactaccatgctgatgatcctctctctccttctcttcccagcttctcctttgttgtctgacaaacacaaacattcccgagaaaactcttgcctgtcaccaagagagagaccatgcagtgccatctatccaacacctgtggagccttcgcagaggatgctgtttaatcatattggagacggggccttgccacgcagtgacccaaatctctctgcacctgaaaaagcttcaccagcaagacacacgacatcagtatccccctcgcctgccgggcgatctccattgaagggctctgtgcagtctttcaccccctctccagtggagtaccactcgccaggactcatctccaactcccctgtcttgtcgggcagctacagcagtgggatttcttctctcagccggtgcagcacgtcggaaacctcaggctttgaaaatcaggtgaatgaacagtcggcccccctgccggtgccagtgccggtgcccgtgccgagctacggcggggaggagccagtgcgcaaggagagcaagactccgcccccgtacagcgtctacgagcggactctgcggcgccccgtcccgctacctcacagcctctccatccccgtcacgtcggagccgcccgcgctgccccccaagcctctggcagcgcgatccagccacctggagaatggggcccggaggactgaccccggcccgcggcccaggcccctgccccgcaaggtctctcagttataagtcacttttctatgtacctgcgatgcattctttgcccgtttacaaaataagaagtatgatgagaagacatttagtgtaggcactttaataacttactcagctccttcgatgaatggaattaaaacttgcttattaaatatcatgttgcacaatattaaaagttgctgatctaaaacgccagatgttaaatgaagtatggctgaatttcattaaaacgtttctcatttggaagtggtaaatagtgataaagactccttttgtacctttttatgttcacttttttttatatagtttaatcttaaaaccaatacgatattgtcaaacgatacaatgtgtgacaatgttgtatcgtttttactgaatacttgatacttggagaaagcttattaagtcagtgcacatcctaacacagtggtccttattttagaagacttctgtaaataaggcaaggtttatcagtgcagatcatcagaattaaagttcaagcaggcgagcaagacagtatacttaaggggttgcaaagcttgggactggaaattgttttgttcttgaaacaaaatacttctttaaggttgcttttgctgtttgactgctgtctacattcgtaaaattctattttgtgaattggtagctaaatcccttactaccctgacaccgtggtatctactgtatttcttttcaaggtgcaatttgcttcagagttccaatcagctagattaagcaagaggctccagaagaaatgtttacttgaattttgcgcttcctttcttgatagtttcctatataaaatttgtcattgaacaagagcaaatgctgaagtattaatgaggcacaaatgactgtgccccattagcaagaattcaggaatcaatacagacagtattaaattaatagcttaagtgaagaaaaaaaaaacttagtgaaaatgtattagcacgattaaatggcaaaaggacttataaaaggcaagggcattaactttcagtcctgcacaaaataaaaaattcctcacgactctccacttttaccagtggagtttgtcttagctgacctgtcgtctttctcttgaaggaggattgctgtagacttctctagcttgaatattgcaacatagcatcttaggtctagatagggatgctaatgccagttgtagaagtgtgaaaaaagcaccttgtatgtagtaatgtattttatatctttgttttttcttttactgactgtttataacactcaattgacaatagatatgaactgtattttaaatcatactgttaaatattttccctcttttgttgggaagctcattttagtttaaccatgtttgttttgttggtagcttacctggaaggcagtgaccacttttttatattctcttaatgaaaccattcagcaggtatatgctgttgaggctggttatagaggttttctataataaatgttcaagtatttttgtatataactggttaattttaataagagataccattatgtgtaaaaaaaagtaaaaataaacgcaaacagttgttgatgcagtatgattgttataattatgccaaatactttacgtatggaaaaagaatatttgtacatatgtgcttttaacaattctgccatattgactttacaattttgaatgtcggaaaaattaatatatgttaaatatttatgtttagtgaaagtgttcataattgagaaaaggaacatatgcattttagctttgtatcttgcaagttttgcagtcagaaattttttgaactagcttttgcttttgataacacttcgtgtttgtaaccacattcatatatatatacatatatatgtgaagctccatatttctgttgctttaaagaagtaaaaccttccatttaaataagatgacatgcataagataacaaagcttccttgatttccttttcctgtgtaatttaatagatttgttgactagtgcttgggcacattataaatcagtgttatttgctcttggagccattttttaaaaaaaattttggcagtgagcagttgaatttatcttgaatttatcatgtgtgtgtatttctgaagcagctacatagcagaacattttaagagattctgttagcccacatgttcatgttggttgctgctgaatggtaaatattaaataaaattaccagattaatcttaatatttctgtctttactcctatcatcagcatgtctttacttgtaatagaagcggctcttgatcttattatagtgagatttccagacttctttttagatagatcctgtttgtgttgtcctgccacgtagatgcatttcacactcactacggctcacttatgccatagggaacaatcaccagaaaggtaacaaacagtatgggttaatatcccatagaaagggtaacatttacctggttggctgaccattcattggcctaaccagagccaacttaacaagtcaaaccatcaaaatgtgtttgcatcagaaaacttgacataaaacagataacttccaagcatataagggcatggttaaatgctggttttgacagctgtggtaaaaatctatctgcatgccaactcttctccctggttttcataaaatgatagaaaatatacatgtgacatacactgaaaaacccactgactacaagatttctattaataaagcctggcttttaa

SEQ ID NO: 436418 - DNA, 2325 bp, Homo sapiens
atctgggattcctacttttacctcgcagtcatttttataaaccagttgtgtctgcagttggagatgttcacaccttccaagaagaaaaaggtgttagaaaagtatggtgacatgcgggtaacaatgggttgtgaaattttcagcatgtggcaaaacctaggagagcacaagcttcattttatccctgccctgattggccccttcctagaagtgaccttgataccccagccagatcttcggaatgtcatgattccaatttttcatgatatgatggactgggagcagaggcggagtggcaactttaaacaggtggaagccaagctaattgacaaactggatagcctgatgtcagaaggcaaaggtgacgaaacataccgcgagctcttcaacagtattctactaaagaaaattgagcgggaaacatggcgggaaagtggcgtttcattaattgctactgtaactcgtctaatggagaggttgttagattacagaacttctataagactgaactgaacaaggaggagatgtatatacgctacattcacaaactctatgatctgcatctcaaagcacagaactttacagaagctgcatataccctcctcttatatgacgagctactggaatggtctgatcggcccctcagggagttcctgacctaccccatgcaaacagaatggcagcgcaaagagcacctgcacctcaccatcatccagaactttgacagaggcaaatgttgggagaatggcattatcttgtgccggaagattgcagagcagtatgagagttattatgactacagaaacctgagcaagatgcggatgatggaagcctctttgtatgacaaaattatggaccagcaacgtcttgaaccagagttcttcagagttggattttatggaaaaaaatttccatttttcttaagaaataaggagtttgtgtgtcgagggcatgactacgagaggctggaagccttccaacagagaatgctgaacgagttcccccatgccatcgccatgcagcacgccaaccagcccgatgagaccatcttccaggcagaagctcagtatttgcagatatatgctgtgactcccattccagagagccaggaggtcctgcagagagagggtgttccggacaacatcaaaagcttctataaagtgaatcacatctggaaattccgctatgaccgaccatttcacaaaggcacaaaagataaagagaatgaattcaagagtctctgggtggagagaacgtcattatacttggtgcagagtttgcctggcatctctcgctggtttgaagtggaaaagcgtgaagtggtagaaatgagtcctctggaaaatgcaattgaagtgctagaaaataagaatcagcagctgaagactctgattagtcagtgtcagacaagacagatgcagaatattaatcccctgactatgtgcctgaatggagttatagatgctgcagttaatggtggcgtttccaggtatcaagaggcattctttgtcaaagaatatatcttaagtcaccctgaagatggggagaaaattgcacgattaagagagctgatgcttgagcaggcacagattctggaatttggtttggccgtgcatgagaagtttgtacctcaagatatgagaccccttcacaaaaagctggttgaccaattctttgtgatgaagtcgagcttagggatacaggagttctctgcttgtatgcaagccagtcctgtccattttcctaatggaagccctcgtgtgtgtagaaactcagcacctgcttctgtgagcccagatggtaccagggtaattcctagacgcagcccgttaagttacccagctgtcaaccgatattcttcctcctcactgtcctcacaagcttctgctgaagtaagcaatattacagggcaatcagaaagctctgatgaagtctttaacatgcagccaagtccatctacctcaagcttgagttctactcactcggcttcacctaatgtgacaagttctgctccatcgagtgccagagcttctcctttgttgtctgacaaacacaaacattcccgagaaaactcttgcctgtcaccaagagagagaccatgcagtgccatctatccaacacctgtggagccttcgcagaggatgctgtttaatcatattggagacggggccttgccacgcagtgacccaaatctctctgcacctgaaaaagctgtgaaccccacccctagcagctggagcctggacagtgggaaggaagccaagaacatgtcggatagtgggaaacttatctctccccctgtccctccaagacccacacagactg

SEQ ID NO: 436419 - DNA, 772 bp, Homo sapiens
  misc_feature (594)..(595): n is a, c, g, or t
  misc_feature (597)..(597): n is a, c, g, or t
  misc_feature (629)..(629): n is a, c, g, or t
gggctaagatgaagcctgaactgattataaaaccttccttggctcagtgcccttcaccactgctggctttttgctgtagctccacattcctgtgcattgaggggttaacattaggctgggaagatgacaaaacttgaagagcatctggagggaattgtcaatatcttccaccaatactcagttcggaaggggcattttgacaccctctctaagggtgagctgaagcagctgcttacaaaggagcttgcaaacaccatcaagaatatcaaagataaagctgtcattgatgaaatattccaaggcctggatgctaatcaagatgaacaggtcgactttcaagaattcatatccctggtagccattgcgctgaaggctgcccattaccacacccacaaagagtaggtagctctctgaaggctttttacccagcaatgtcctcaatgagggtcttttctttccctcaccaaaacccagccttgcccgtggggagtaagagttaataaacacactcacgaaaagttaaaaaaaaaaaaaaaaaaaaaaaaaaaaaaaaaaaaaaaaaaaaaaaaaaaaaaaaaaaaaaaaaaaaaaaannanggggaaaaaaaaaaaaaaaaaaaaaaaaaaancccttgtgggccccttggccccatggatttttaaattgaagcaggttattccttgcggccgaatttgaagctcattggccaatttccccttatagggagcgatttcaaaattcattggccggggtttaaaagttgggacttga

SEQ ID NO: 436420 - DNA, 521 bp, Homo sapiens
gggctaagatgaagcctgaactgattataaaaccttccttggctcagtgcccttcaccactgctggctttttgctgtagctccacattcctgtgcattgaggggttaacattaggctgggaagatgacaaaacttgaagagcatctggagggaattgtcaatatcttccaccaatactcagttcggaaggggcattttgacaccctctctaagggtgagctgaagcagctgcttacaaaggagcttgcaaacaccatcaagaatatcaaagataaagctgtcattgatgaaatattccaaggcctggatgctaatcaagatgaacaggtcgactttcaagaattcatatccctggtagccattgcgctgaaggctgcccattaccacacccacaaagagtaggtagctctctgaaggctttttacccagcaatgtcctcaatgagggtcttttctttccctcaccaaaacccagccttgcccgtggggagtaagagttaataaacacactcacgaaaagtt

SEQ ID NO: 436421 - DNA, 1614 bp, Homo sapiens
gtgcccgagccaggccggcctccccgccccctccctggaaaggaaaggccccggcgacaacagagccagacccgctcatcccgatctcccagaaggcgactgacagctgactgccagaaggagatcgcgccaggagactgactgctctgtgcccacccggggacccgggcccgttcagccgggctggctggtgcgccctctgcaaagcctgcgccagggaggaggcaggctcaaccttcagattcccagggcctctctgtcgctgtcgccgtcgccgtcgcccgaggtcccagcggctctaccagattgttgtggaggcctctcacccgcacagatctcccctgcgaccatgtcttccattaagattgagtgtgttttgccagagaactgccggtgtggtgagtctccagtatgggaggaagtgtccaactctctgctctttgtagacattcctgcaaaaaaggtttgccggtgggattcattcaccaagcaagtacagcgagtgaccatggatgccccagtcagctccgtggctcttcgccagtcgggaggctatgttgccaccattggaacaaagttctgtgctttgaactggaaagaacaatcagcagttgtcttggccacggtggataacgacaagaaaaacaatcgcttcaatgatgggaaggtggatcccgccgggaggtactttgctggcaccatggctgaggaaacagctccagcagttcttgagcggcaccagggggccctgtactccctctttcctgatcaccacgtgaaaaagtactttgaccaggtggacatttccaatggtttggattggtcgctagaccacaaaatcttctattacattgacagcctgtcctactccgtggatgcctttgactatgacctgcagacaggacagatctccaaccgcagaagtgtttacaagctagaaaaggaagaacaaatcccagatggaatgtgtattgatgctgaggggaagctctgggtggcctgttacaatggaggaagagtgattcgtttagatcctgtgacagggaaaagacttcaaactgtgaagttgcctgttgataaaacaacttcatgctgctttggagggaagaattactctgaaatgtatgtgacctgcgcccgggatgggatggaccccgagggtcttttgaggcaacctgaagctggtggaattttcaagataactggtctgggggtcaaaggaattgctccctactcctatgcgggatgaggacaggtcttctttcctgccagagggagctctgaagacaactagagaattctgggcctgaaatttcaatctagttagaaagaaaaatgaggcaatgattttattaacagcgttaagttttaatttacaacttttaaaaggcagagcatttttaacaaggggtgacaggtggttttgataacacacttataaggctttctgtaaaaggtactatagaagggcgaagaatcgttcaactgtcaatcagcctcttgattctttgtaaattgccagggtgggtgggtacatatctcttcttgattctgcatttcatacttaactatattaaagcttcaaggaacaataaatagtaacctggtaatgac

SEQ ID NO: 436422 - DNA, 2234 bp, Homo sapiens
gtgcccgagccaggccggcctccccgccccctccctggaaaggaaaggccccggcgacaacagagccagacccgctcatcccgatctcccagaaggcgactgacagctgactgccagaaggagatcgcgccaggagactgactgctctgtgcccacccggggacccgggcccgttcagccgggctggctggtgcgccctctgcaaagcctgcgccagggaggaggcaggctcaaccttcagattcccagggcctctctgtcgctgtcgccgtcgccgtcgcccgaggtcccagcggctctaccagattgttgtggaggcctctcacccgcacagataatttttctctgtcttctcccagttcgctggtcatggtctctggcctaaagtcccagcatagactgttcctctcctgtggagtctaacactctttgccaaactggcacggtgtcttcctgggaagcaagaaatcactgagggcctgtcagttcctgccagggtggttcgatgctgtccttttctccactccttccatggtctgcgttggaaaatgtgtgttagttcgaattcagcgagttctcattggggtgaacatagtcctaaaaatgcagttcataaaaatcaaccacacagagaagaaaaataaataaatcagtaaagcagctcagaaaaatgcaggtgtggcgggccctggcctctgcaccctcatagaggggctcaacagcatcaacagaaggtgggggagcagaaggtgccctgcagacacccagaggggccaccaatgagcaaactgccagctccctgacccgccctggggcccagggtattgacataaaggacggccttgcactatttcaacagccagttctctgagggtcacaaacaccaaggagtggaggtcagagtgtcacttttttgttttctttttgaaagatcattcgagaaacacgtcactgatctcccctgcgaccatgtcttccattaagattgagtgtgttttgccagagaactgccggtgtggtgagtctccagtatgggaggaagtgtccaactctctgctctttgtagacattcctgcaaaaaaggtttgccggtgggattcattcaccaagcaagtacagcgagtgaccatggatgccccagtcagctccgtggctcttcgccagtcgggaggctatgttgccaccattggaacaaagttctgtgctttgaactggaaagaacaatcagcagttgtcttggccacggtggataacgacaagaaaaacaatcgcttcaatgatgggaaggtggatcccgccgggaggtactttgctggcaccatggctgaggaaacagctccagcagttcttgagcggcaccagggggccctgtactccctctttcctgatcaccacgtgaaaaagtactttgaccaggtggacatttccaatggtttggattggtcgctagaccacaaaatcttctattacattgacagcctgtcctactccgtggatgcctttgactatgacctgcagacaggacagatctccaaccgcagaagtgtttacaagctagaaaaggaagaacaaatcccagatggaatgtgtattgatgctgaggggaagctctgggtggcctgttacaatggaggaagagtgattcgtttagatcctgtgacagggaaaagacttcaaactgtgaagttgcctgttgataaaacaacttcatgctgctttggagggaagaattactctgaaatgtatgtgacctgcgcccgggatgggatggaccccgagggtcttttgaggcaacctgaagctggtggaattttcaagataactggtctgggggtcaaaggaattgctccctactcctatgcgggatgaggacaggtcttctttcctgccagagggagctctgaagacaactagagaattctgggcctgaaatttcaatctagttagaaagaaaaatgaggcaatgattttattaacagcgttaagttttaatttacaacttttaaaaggcagagcatttttaacaaggggtgacaggtggttttgataacacacttataaggctttctgtaaaaggtactatagaagggcgaagaatcgttcaactgtcaatcagcctcttgattctttgtaaattgccagggtgggtgggtacatatctcttcttgattctgcatttcatacttaactatattaaagcttcaaggaacaataaatagtaacctggtaatgac

SEQ ID NO: 436423 - DNA, 444 bp, Homo sapiens
ttttaaaaggcagagcatttttaacaaggggtgacaggtggttttgataacacacttataaggctttctgtaaaaggtactatagaagggcgaagaatcgttcaactgtcaatcagcctcttgattctttgtaaattgccagggtgggtgggtacatatctcttcttgattctgcatttcatacttaactatattaaagcttcaaggaacaataaatagtaacctggtaatgaccctattatgttcctttttattttcatcacaatcttataaaatataccacaatgctaactaacctacatagatatttcatctcctatatgttattttacaaactaaaatacggctggagggttagactcaaacatgctgtcaaaatccatggttccagctgccacctactggatgtaaaagtaatatgtctctttggaaagaatacttatt

SEQ ID NO: 436424 - DNA, 2184 bp, Homo sapiens
gtgcccgagccaggccggcctccccgccccctccctggaaaggaaaggccccggcgacaacagagccagacccgctcatcccgatctcccagaaggcgactgacagctgactgccagaaggagatcgcgccaggagactgactgctctgtgcccacccggggacccgggcccgttcagccgggctggctggtgcgccctctgcaaagcctgcgccagggaggaggcaggctcaaccttcagattcccagggcctctctgtcgctgtcgccgtcgccgtcgcccgaggtcccagcggctctaccagattgttgtggaggcctctcacccgcacagataatttttctctgtcttctcccagttcgctggtcatggtctctggcctaaagtcccagcatagactgttcctctcctgtggagtctaacactctttgccaaactggcacggtgtcttcctgggaagcaagaaatcactgagggcctgtcagttcctgccagggtggttcgatgctgtccttttctccactccttccatggtctgcgttggaaaatgtgtgttagttcgaattcagcgagttctcattggggtgaacatagtcctaaaaatgcagttcataaaaatcaaccacacagagaagaaaaataaataaatcagtaaagcagctcagaaaaatgcaggtgtggcgggccctggcctctgcaccctcatagaggggctcaacagcatcaacagaaggtgggggagcagaaggtgccctgcagacacccagaggggccaccaatgagcaaactgccagctccctgacccgccctggggcccagggtattgacataaaggacggccttgcactatttcaacagccagttctctgagggtcacaaacaccaaggagtggaggtcagagtgtcacttttttgttttctttttgaaagatcattcgagaaacacgtcactgatctcccctgcgaccatgtcttccattaagattgagtgtgttttgccagagaactgccggtgtggtgagtctccagtatgggaggaagtgtccaactctctgctctttgtagacattcctgcaaaaaaggtttgccggtgggattcattcaccaagcaagtacagcgagtgaccatggatgccccagtcagctccgtggctcttcgccagtcgggaggctatgttgccaccattggaacaaagttctgtgctttgaactggaaagaacaatcagcagttgtcttggccacggtggataacgacaagaaaaacaatcgcttcaatgatgggaaggtggatcccgccgggaggtactttgctggcaccatggctgaggaaacagctccagcagttcttgagcggcaccagggggccctgtactccctctttcctgatcaccacgtgaaaaagtactttgaccaggtggacatttccaatggtttggattggtcgctagaccacaaaatcttctattacattgacagcctccaaccgcagaagtgtttacaagctagaaaaggaagaacaaatcccagatggaatgtgtattgatgctgaggggaagctctgggtggcctgttacaatggaggaagagtgattcgtttagatcctgtgacagggaaaagacttcaaactgtgaagttgcctgttgataaaacaacttcatgctgctttggagggaagaattactctgaaatgtatgtgacctgcgcccgggatgggatggaccccgagggtcttttgaggcaacctgaagctggtggaattttcaagataactggtctgggggtcaaaggaattgctccctactcctatgcgggatgaggacaggtcttctttcctgccagagggagctctgaagacaactagagaattctgggcctgaaatttcaatctagttagaaagaaaaatgaggcaatgattttattaacagcgttaagttttaatttacaacttttaaaaggcagagcatttttaacaaggggtgacaggtggttttgataacacacttataaggctttctgtaaaaggtactatagaagggcgaagaatcgttcaactgtcaatcagcctcttgattctttgtaaattgccagggtgggtgggtacatatctcttcttgattctgcatttcatacttaactatattaaagcttcaaggaacaataaatagtaacctggtaatgac

SEQ ID NO: 436425 - DNA, 2232 bp, Homo sapiens
cctgaagctccggactacagctcccaggcctctccaagcccctaccgcacaggctcatagccccaagcccggaggaggtggctacattgtgtctattgtatcccttggctggtgtatttgtacatctctcgggacgtgaaattgacagtgaaaagtatggcagatgagcaagaaatcatgtgcaaattggaaagcattaaagagatcaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtgatggaaaacactatcaaacaatctgagaatgacctaaacaagctgctagagtctacaaggaggctgcatgatgagtataagccactgaaagaacatgtggatgccctgcgcatgactctgggcctgcagaggctccctgacttgtgtgaagaagaggagaagctttccttggattactttgagaagcagaaagcagaatggcagacagaacctcaggagccccccatccctgagtccctggccgctgcagccgctgccgcccaacagctccaagtggctaggaagcaggatactcggcagacggccaccttcaggcagcagcccccacctatgaaggcctgcttgtcatgtcaccagcaaattcaccggaatgcacctatatgccctctttgcaaggccaagagtcggtcccggaaccccaaaaagccgaaacggaagcaggatgaataaagaaagggagagcacatgaagctttgctaattataacccctcaccttgaccagagtcattgatgtcctgatgtgaaacaacccttgcccaaccccacgaagtctcctatttaatgtgatggaagcacaacccctctctcactttgctcctatttctttctgctcttgggatttctggtttaggaagagatgtggttcaggtgctaaacagtgtgtctgatgatcccttctctcccactcacatttcaacccctgcccttgtttggagctaagggaagggcaaaaggctcagatatgattctctatctcttgtgcctgaggcctggagcctaaggagctgtagggtctgaggggcaggggaggcccatatcttgtttcaggtaaaggacccagtatttcccctccttgtacttttgccttaggttctcaagggacaatagtcttcatgttggattctccaacaggctgggtgcatgtatccccctactcctaccctcatctcatccttaaggcccagaggtagcttggacaagccctccttttcataatcatttgggaggcatggctgtaattctttagctttctccacttctgtctcccacatatactaaaattcttaggtactaggctgtgtgtcttgggatcttaagatcaatgaacctttccccaatatctagtctttgcaaattctagtagaagatttccacagtgaaatcagtgagccagaccaactctacatctcctgcctaacctactgcctaagtcattagggctgagggctcggctgtaggggcttccttaggctgagagtgcccccaggctgacatctgtgttggcttttgttcagaaccattactctggcacatgctcaatggtatattgcagggaggagaggagtagatttagatttgagtaaatgccaatcactttacacatgaaggtgggtgggactttccttccattcatcccttgctctcttggatctgaactcttctggagcctcagctcaggatagctgctggccactcctgtcctgtggattgtgcaggtggcctttcctcccaaaagaaaaggcatcaggctccccaagccccacagctctcctttccaccaaagccaggtttcctggtaaggtcactcgaagataagggatggggatgggggctgactgacaaaaaattttagccccaggtctcagtacctggctggggagggggatatttttccttccttaagtagttttacattgccacagtgtgtatgtgttcactatataaaatgttcctctgctctttgaaagtaagagtgttgtgtctgtacaaatccttttaacatgcattcattggagtaaattctgagtatctactgtgtattggataatacaaaagatgtaatgtcattt

SEQ ID NO: 436426 - DNA, 2213 bp, Homo sapiens
  misc_feature (7)..(11): n is a, c, g, or t
aggggannnnnagaaacatacggctaggtacgaggctgggtggtcaagcccggaggaggtggctacattgtgtctattgtatcccttggctggtgtatttgtacatctctcgggacgtgaaattgacagtgaaaagtatggcagatgagcaagaaatcatgtgcaaattggaaagcattaaagagatcaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtgatggaaaacactatcaaacaatctgagaatgacctaaacaagctgctagagtctacaaggaggctgcatgatgagtataagccactgaaagaacatgtggatgccctgcgcatgactctgggcctgcagaggctccctgacttgtgtgaagaagaggagaagctttccttggattactttgagaagcagaaagcagaatggcagacagaacctcaggagccccccatccctgagtccctggccgctgcagccgctgccgcccaacagctccaagtggctaggaagcaggatactcggcagacggccaccttcaggcagcagcccccacctatgaaggcctgcttgtcatgtcaccagcaaattcaccggaatgcacctatatgccctctttgcaaggccaagagtcggtcccggaaccccaaaaagccgaaacggaagcaggatgaataaagaaagggagagcacatgaagctttgctaattataacccctcaccttgaccagagtcattgatgtcctgatgtgaaacaacccttgcccaaccccacgaagtctcctatttaatgtgatggaagcacaacccctctctcactttgctcctatttctttctgctcttgggatttctggtttaggaagagatgtggttcaggtgctaaacagtgtgtctgatgatcccttctctcccactcacatttcaacccctgcccttgtttggagctaagggaagggcaaaaggctcagatatgattctctatctcttgtgcctgaggcctggagcctaaggagctgtagggtctgaggggcaggggaggcccatatcttgtttcaggtaaaggacccagtatttcccctccttgtacttttgccttaggttctcaagggacaatagtcttcatgttggattctccaacaggctgggtgcatgtatccccctactcctaccctcatctcatccttaaggcccagaggtagcttggacaagccctccttttcataatcatttgggaggcatggctgtaattctttagctttctccacttctgtctcccacatatactaaaattcttaggtactaggctgtgtgtcttgggatcttaagatcaatgaacctttccccaatatctagtctttgcaaattctagtagaagatttccacagtgaaatcagtgagccagaccaactctacatctcctgcctaacctactgcctaagtcattagggctgagggctcggctgtaggggcttccttaggctgagagtgcccccaggctgacatctgtgttggcttttgttcagaaccattactctggcacatgctcaatggtatattgcagggaggagaggagtagatttagatttgagtaaatgccaatcactttacacatgaaggtgggtgggactttccttccattcatcccttgctctcttggatctgaactcttctggagcctcagctcaggatagctgctggccactcctgtcctgtggattgtgcaggtggcctttcctcccaaaagaaaaggcatcaggctccccaagccccacagctctcctttccaccaaagccaggtttcctggtaaggtcactcgaagataagggatggggatgggggctgactgacaaaaaattttagccccaggtctcagtacctggctggggagggggatatttttccttccttaagtagttttacattgccacagtgtgtatgtgttcactatataaaatgttcctctgctctttgaaagtaagagtgttgtgtctgtacaaatccttttaacatgcattcattggagtaaattctgagtatctactgtgtattggataatacaaaagatgtaatgtcattt

SEQ ID NO: 436427 - DNA, 2793 bp, Homo sapiens
  misc_feature (7)..(11): n is a, c, g, or t
aggggannnnnagaaacatacggctaggtacgaggctgggtggtcaagcccggaggaggtggctacattgtgtctattgtatcccttggctggtgtatttgtacatctctcgggacgtgaaattgacagtgaaaagtatggcagatgagcaagaaatcatgtgcaaattggaaagcattaaagagatcaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtgatggaaaacactatcaaacaatctgagaatgacctaaacaagctgctagagtctacaaggaggctgcatgatgagtataagccactgaaagaacatgtggatgccctgcgcatgactctgggcctgcagaggctccctgacttgtgtgaagaagaggagaagctttccttggattactttgagaagcagaaagcagaatggcagacagaacctcaggagccccccatccctgagtccctggccgctgcagccgctgccgcccaacagctccaagtggctaggaagcaggatactcggcagacggccaccttcaggcagcagcccccacctatgaaggcctgcttgtcatgtcaccagcaaattcaccggaatgcacctatatgccctctttgcaaggccaagagtcggtcccggaaccccaaaaagccgaaacggaagcaggatgaataaagaaagggagagcacatgaagctttgctaattataacccctcaccttgaccagagtcattgatgtcctgatgtgaaacaacccttgcccaaccccacgaagtctcctatttaatgtgatggaagcacaacccctctctcactttgctcctatttctttctgctcttgggatttctggtttaggaagagatgtggttcaggtgctaaacagtgtgtctgatgatcccttctctcccactcacatttcaacccctgcccttgtttggagctaagggaagggcaaaaggctcagatatgattctctatctcttgtgcctgaggcctggagcctaaggagctgtagggtctgaggggcaggggaggcccatatcttgtttcaggtaaaggacccagtatttcccctccttgtacttttgccttaggttctcaagggacaatagtcttcatgttggattctccaacaggctgggtgcatgtatccccctactcctaccctcatctcatccttaaggcccagaggtagcttggacaagccctccttttcataatcatttgggaggcatggctgtaattctttagctttctccacttctgtctcccacatatactaaaattcttaggtactaggctgtgtgtcttgggatcttaagatcaatgaacctttccccaatatctagtctttgcaaattctagtagaagatttccacagtgaaatcagtgagccagaccaactctacatctcctgcctaacctactgcctaagtcattagggctgagggctcggctgtaggggcttccttaggctgagagtgcccccaggctgacatctgtgttggcttttgttcagaaccattactctggcacatgctcaatggtatattgcagggaggagaggagtagatttagatttgagtaaatgccaatcactttacacatgaaggtgggtgggactttccttccattcatcccttgctctcttggatctgaactcttctggagcctcagctcaggatagctgctggccactcctgtcctgtggattgtgcaggtggcctttcctcccaaaagaaaaggcatcaggctccccaagccccacagctctcctttccaccaaagccaggtttcctggtaaggtcactcgaagataagggatggggatgggggctgactgacaaaaaattttagccccaggtctcagtacctggctggggagggggatatttttccttccttaagtagttttacattgccacagtgtgtatgtgttcactatataaaatgttcctctgctctttgaaagtaagagtgttgtgtctgtacaaatccttttaacatgcattcattggagtaaattctgagtatctactgtgtattggataatacaaaagatgtaatgtcatttacctttctgggtagctcttgtttgctcttattcattccaccttacaaatgagaaagccaggcaccaaggacaataatttacctaattatcacaataatttccatttatttagcacctactctgtgccaggtacctatgcaagttgcttaatataaatgattgtatttgacttccaaaataccttacaagctaagtattcttatcaccattttaaaaaaaaagggatactgaacctccaaaaacttaaaagctttttcagagttaaacagctagtaagaggaaattgcaggatttggagccagctttgtccaactccagagctcatttttttctacttcttctccatgatcatttttaagaaaacctttctccctttcagaatggcttgatgatgagagtggttgaaataactttggaactgaaatcaagaactgggtgtcaaatgactgattcagggatataaaggccaagggctctctaaataatatcctgtacactaatctgtctctgtgcttgtcagggaattcaacagctaaataaaacctctctgtgcctcagtgtcctcatctggaaaatgggg

SEQ ID NO: 436428 - DNA, 4255 bp, Homo sapiens
cctgaagctccggactacagctcccaggcctctccaagcccctaccgcacaggctcatagccccaagcccggaggaggtggctacattgtgtctattgtatcccttggctggtgtatttgtacatctctcgggacgtgaaattgacagtgaaaagtatggcagatgagcaagaaatcatgtgcaaattggaaagcattaaagagatcaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtgatggaaaacactatcaaacaatctgagaatgacctaaacaagctgctagagtctacaaggaggctgcatgatgagtataagccactgaaagaacatgtggatgccctgcgcatgactctgggcctgcagaggctccctgacttgtgtgaagaagaggagaagctttccttggagtaagctacctgcccccagtccctacaacataccctccctccgacccacatacatacttacatacctacacacacacgggcaggtatacatacacaaagcctagcctgaaagtcagagtgcctagttttagtcccaggcctttcagtggcttactcactgtgtgatcttgggcaagtctctgtgccagcttgttaaaacagaaggaggattattaaactggatgaattactagatgaattagaacaactactaggtggctttttaaattctttgtgtgatattgacaatacaagactatgtctataactcttaagagatcatttcccaagtcagggtctagaaggcgatatctagaaacctctaaaaacaaaaaagactgagctttcctggtcttcaggaagtggcctgggacttacttcatctcctggctcagagttaagaactaggcttgccttgcagagagacagaatttgacctggtagaggaaatcatttcctaaaggtagagcaaggtgtctgtggagtttgtgagcttcctactcttagagatatgtcaccagaggccttaggacacttaataggaatactcaaaagagcatgagatagcagataggactgaataccctttaaggatcttgctagccctaagatttcttggtcttcttggcctatcagagctaaggacaaagaggattacccttctcatcagacattgggcctagtacccagggacaatagccttgtgcttgggaaggtgtggggaccttctagaatgagccacagctcaacccttggttgtatggcatggagtctttaagaggagcaaggttctcattgctttcagaatgatctagccagtgtctctcatctccaaagttactttgagaagcagaaagcagaatggcagacagaacctcaggagccccccatccctgagtccctggccgctgcagccgctgccgcccaacagctccaagtggctaggaagcaggatactcggcagacggccaccttcaggcagcagcccccacctatgaagaggtaagtgagctgggtaatggttgtggaggaagcaaagtatcctcccatggaagggccgtggaaggctagttctgggtctttggctttatttatgctgggccttcttttaatggcctttgcttgtgacacagtggaaggggtgacatgggtgtgctgtgttggacacacacagcacaggttttgttgccccatgttcccagaggtgttagaatgcagggagattttcaggccctgctagagtgcaattctaaaagttagaaatgactcttacacaaagatgtaatgagcatgtatcataaatgagggaaccagcaggattataaagctggttccaggagcatttggaacaaatatctatatagtcaagaaaggagaggaaggctgaaacaaatttgcaaagttagatgcaaaactggtttacatcccacaggacaataaaactgtaactttatagttactttttcttccaaacagaagtaatttgcatctctactgggcaaaagccatttgcagcttatcagtgtaacatcacagagcctgggtcctaatcaattggtaaatagtcaaacaaagagacattcttctagagcaggggtcatcaaattacagcctacaggtcaaatctaatctgttccctgttttcgttaaagttttattggcccacatgcatgtctgtgtttgcaagctattgcaaacaacatgcatgcaagctattgtctatcacttctttcatgcaaaacagaattgagtagttgcagcaagtttatatgatgtaaaaagtctaaagtatttgctgtcctggcctttacagaaaatgtttgttgacccctgttctagaaaattaaatagtccttaagtgggcctgttagacaatgcttcattataatgacgaaaagatgtgtagttctcattttgccttactttctagttttgtatactttttctcaacaccattctctgaactgggttatgtccttccttcccatcttccatggcatccaagaatacttgagtctactcactgattattgctctcttctgatgggaaatcactttgctttctgggcccctggggaatcagaagtctaagttgttgcctggaagaatctgactactaactttctttttcctgtgtccctcaccaggcctgcttgtcatgtcaccagcaaattcaccggaatgcacctatatgccctctttgcaaggccaagagtcggtcccggaaccccaaaaagccgaaacggaagcaggatgaataaagaaagggagagcacatgaagctttgctaattataacccctcaccttgaccagagtcattgatgtcctgatgtgaaacaacccttgcccaaccccacgaagtctcctatttaatgtgatggaagcacaacccctctctcactttgctcctatttctttctgctcttgggatttctggtttaggaagagatgtggttcaggtgctaaacagtgtgtctgatgatcccttctctcccactcacatttcaacccctgcccttgtttggagctaagggaagggcaaaaggctcagatatgattctctatctcttgtgcctgaggcctggagcctaaggagctgtagggtctgaggggcaggggaggcccatatcttgtttcaggtaaaggacccagtatttcccctccttgtacttttgccttaggttctcaagggacaatagtcttcatgttggattctccaacaggctgggtgcatgtatccccctactcctaccctcatctcatccttaaggcccagaggtagcttggacaagccctccttttcataatcatttgggaggcatggctgtaattctttagctttctccacttctgtctcccacatatactaaaattcttaggtactaggctgtgtgtcttgggatcttaagatcaatgaacctttccccaatatctagtctttgcaaattctagtagaagatttccacagtgaaatcagtgagccagaccaactctacatctcctgcctaacctactgcctaagtcattagggctgagggctcggctgtaggggcttccttaggctgagagtgcccccaggctgacatctgtgttggcttttgttcagaaccattactctggcacatgctcaatggtatattgcagggaggagaggagtagatttagatttgagtaaatgccaatcactttacacatgaaggtgggtgggactttccttccattcatcccttgctctcttggatctgaactcttctggagcctcagctcaggatagctgctggccactcctgtcctgtggattgtgcaggtggcctttcctcccaaaagaaaaggcatcaggctccccaagccccacagctctcctttccaccaaagccaggtttcctggtaaggtcactcgaagataagggatggggatgggggctgactgacaaaaaattttagccccaggtctcagtacctggctggggagggggatatttttccttccttaagtagttttacattgccacagtgtgtatgtgttcactatataaaatgttcctctgctctttgaaagtaagagtgttgtgtctgtacaaatccttttaacatgcattcattggagtaaattctgagtatctactgtgtattggataatacaaaagatgtaatgtcattt

SEQ ID NO: 436429 - DNA, 2672 bp, Homo sapiens
  misc_feature (7)..(11): n is a, c, g, or t
aggggannnnnagaaacatacggctaggtacgaggctgggtggtgtttcctgctttttgcaaattgcaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtgatggaaaacactatcaaacaatctgagaatgacctaaacaagctgctagagtctacaaggaggctgcatgatgagtataagccactgaaagaacatgtggatgccctgcgcatgactctgggcctgcagaggctccctgacttgtgtgaagaagaggagaagctttccttggattactttgagaagcagaaagcagaatggcagacagaacctcaggagccccccatccctgagtccctggccgctgcagccgctgccgcccaacagctccaagtggctaggaagcaggatactcggcagacggccaccttcaggcagcagcccccacctatgaaggcctgcttgtcatgtcaccagcaaattcaccggaatgcacctatatgccctctttgcaaggccaagagtcggtcccggaaccccaaaaagccgaaacggaagcaggatgaataaagaaagggagagcacatgaagctttgctaattataacccctcaccttgaccagagtcattgatgtcctgatgtgaaacaacccttgcccaaccccacgaagtctcctatttaatgtgatggaagcacaacccctctctcactttgctcctatttctttctgctcttgggatttctggtttaggaagagatgtggttcaggtgctaaacagtgtgtctgatgatcccttctctcccactcacatttcaacccctgcccttgtttggagctaagggaagggcaaaaggctcagatatgattctctatctcttgtgcctgaggcctggagcctaaggagctgtagggtctgaggggcaggggaggcccatatcttgtttcaggtaaaggacccagtatttcccctccttgtacttttgccttaggttctcaagggacaatagtcttcatgttggattctccaacaggctgggtgcatgtatccccctactcctaccctcatctcatccttaaggcccagaggtagcttggacaagccctccttttcataatcatttgggaggcatggctgtaattctttagctttctccacttctgtctcccacatatactaaaattcttaggtactaggctgtgtgtcttgggatcttaagatcaatgaacctttccccaatatctagtctttgcaaattctagtagaagatttccacagtgaaatcagtgagccagaccaactctacatctcctgcctaacctactgcctaagtcattagggctgagggctcggctgtaggggcttccttaggctgagagtgcccccaggctgacatctgtgttggcttttgttcagaaccattactctggcacatgctcaatggtatattgcagggaggagaggagtagatttagatttgagtaaatgccaatcactttacacatgaaggtgggtgggactttccttccattcatcccttgctctcttggatctgaactcttctggagcctcagctcaggatagctgctggccactcctgtcctgtggattgtgcaggtggcctttcctcccaaaagaaaaggcatcaggctccccaagccccacagctctcctttccaccaaagccaggtttcctggtaaggtcactcgaagataagggatggggatgggggctgactgacaaaaaattttagccccaggtctcagtacctggctggggagggggatatttttccttccttaagtagttttacattgccacagtgtgtatgtgttcactatataaaatgttcctctgctctttgaaagtaagagtgttgtgtctgtacaaatccttttaacatgcattcattggagtaaattctgagtatctactgtgtattggataatacaaaagatgtaatgtcatttacctttctgggtagctcttgtttgctcttattcattccaccttacaaatgagaaagccaggcaccaaggacaataatttacctaattatcacaataatttccatttatttagcacctactctgtgccaggtacctatgcaagttgcttaatataaatgattgtatttgacttccaaaataccttacaagctaagtattcttatcaccattttaaaaaaaaagggatactgaacctccaaaaacttaaaagctttttcagagttaaacagctagtaagaggaaattgcaggatttggagccagctttgtccaactccagagctcatttttttctacttcttctccatgatcatttttaagaaaacctttctccctttcagaatggcttgatgatgagagtggttgaaataactttggaactgaaatcaagaactgggtgtcaaatgactgattcagggatataaaggccaagggctctctaaataatatcctgtacactaatctgtctctgtgcttgtcagggaattcaacagctaaataaaacctctctgtgcctcagtgtcctcatctggaaaatgggg

SEQ ID NO: 436430 - DNA, 2079 bp, Homo sapiens
  misc_feature (3)..(3): n is a, c, g, or t
  misc_feature (14)..(14): n is a, c, g, or t
  misc_feature (26)..(26): n is a, c, g, or t
canctaggctagtngaggcccgtgtnaatcggccgaggccaagcccggaggaggtggctacattgtgtctattgtatcccttggctggtgtatttgtacatctctcgggacgtgaaattgacagtgaaaagtatggcagatgagcaagaaatcatgtgcaaattggaaagcattaaagagatcaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtgatggaaaacactatcaaacaatctgagaatgacctaaacaagctgctagagtctacaaggaggctgcatgatgagtataagccactgaaagaacatgtggatgccctgcgcatgactctgggcctgcagaggctccctgacttgtgtgaagaagaggagaagctttccttggattactttgagaggcagcagcccccacctatgaaggcctgcttgtcatgtcaccagcaaattcaccggaatgcacctatatgccctctttgcaaggccaagagtcggtcccggaaccccaaaaagccgaaacggaagcaggatgaataaagaaagggagagcacatgaagctttgctaattataacccctcaccttgaccagagtcattgatgtcctgatgtgaaacaacccttgcccaaccccacgaagtctcctatttaatgtgatggaagcacaacccctctctcactttgctcctatttctttctgctcttgggatttctggtttaggaagagatgtggttcaggtgctaaacagtgtgtctgatgatcccttctctcccactcacatttcaacccctgcccttgtttggagctaagggaagggcaaaaggctcagatatgattctctatctcttgtgcctgaggcctggagcctaaggagctgtagggtctgaggggcaggggaggcccatatcttgtttcaggtaaaggacccagtatttcccctccttgtacttttgccttaggttctcaagggacaatagtcttcatgttggattctccaacaggctgggtgcatgtatccccctactcctaccctcatctcatccttaaggcccagaggtagcttggacaagccctccttttcataatcatttgggaggcatggctgtaattctttagctttctccacttctgtctcccacatatactaaaattcttaggtactaggctgtgtgtcttgggatcttaagatcaatgaacctttccccaatatctagtctttgcaaattctagtagaagatttccacagtgaaatcagtgagccagaccaactctacatctcctgcctaacctactgcctaagtcattagggctgagggctcggctgtaggggcttccttaggctgagagtgcccccaggctgacatctgtgttggcttttgttcagaaccattactctggcacatgctcaatggtatattgcagggaggagaggagtagatttagatttgagtaaatgccaatcactttacacatgaaggtgggtgggactttccttccattcatcccttgctctcttggatctgaactcttctggagcctcagctcaggatagctgctggccactcctgtcctgtggattgtgcaggtggcctttcctcccaaaagaaaaggcatcaggctccccaagccccacagctctcctttccaccaaagccaggtttcctggtaaggtcactcgaagataagggatggggatgggggctgactgacaaaaaattttagccccaggtctcagtacctggctggggagggggatatttttccttccttaagtagttttacattgccacagtgtgtatgtgttcactatataaaatgttcctctgctctttgaaagtaagagtgttgtgtctgtacaaatccttttaacatgcattcattggagtaaattctgagtatctactgtgtattggataatacaaaagatgtaatgtcattt

SEQ ID NO: 436431 - DNA, 772 bp, Homo sapiens
  misc_feature (3)..(3): n is a, c, g, or t
  misc_feature (14)..(14): n is a, c, g, or t
  misc_feature (26)..(26): n is a, c, g, or t
canctaggctagtngaggcccgtgtnaatcggccgaggcatatctagtctttgcaaattctagtagaagatttccacagtgaaatcagtgagccagaccaactctacatctcctgcctaacctactgcctaagtcattagggctgagggctcggctgtaggggcttccttaggctgagagtgcccccaggctgacatctgtgttggcttttgttcagaaccattactctggcacatgctcaatggtatattgcagggaggagaggagtagatttagatttgagtaaatgccaatcactttacacatgaaggtgggtgggactttccttccattcatcccttgctctcttggatctgaactcttctggagcctcagctcaggatagctgctggccactcctgtcctgtggattgtgcaggtggcctttcctcccaaaagaaaaggcatcaggctccccaagccccacagctctcctttccaccaaagccaggtttcctggtaaggtcactcgaagataagggatggggatgggggctgactgacaaaaaattttagccccaggtctcagtacctggctggggagggggatatttttccttccttaagtagttttacattgccacagtgtgtatgtgttcactatataaaatgttcctctgctctttgaaagtaagagtgttgtgtctgtacaaatccttttaacatgcattcattggagtaaattctgagtatctactgtgtattggataatacaaaagatgtaatgtcattt

SEQ ID NO: 436432 - DNA, 1086 bp, Homo sapiens
actagttctctctctctcgtctctgctgagtttgaggcacttgagtcagaggaaaggcacctgaaggaatacaagcaggagatggaccttctgctacaggagaagatggcccatgtggaggaactccgactgatccacgctgacatcaatgtgatggaaaacactatcaaacaatctgagaatgacctaaacaaccccacagctctcctttccaccaaagccaggtttcctggtaaggtcactcgaagataagggatggggatgggggctgactgacaaaaaattttagccccaggtctcagtacctggctggggagggggatatttttccttccttaagtagttttacattgccacagtgtgtatgtgttcactatataaaatgttcctctgctctttgaaagtaagagtgttgtgtctgtacaaatccttttaacatgcattcattggagtaaattctgagtatctactgtgtattggataatacaaaagatgtaatgtcatttacctttctgggtagctcttgtttgctcttattcattccaccttacaaatgagaaagccaggcaccaaggacaataatttacctaattatcacaataatttccatttatttagcacctactctgtgccaggtacctatgcaagttgcttaatataaatgattgtatttgacttccaaaataccttacaagctaagtattcttatcaccattttaaaaaaaaagggatactgaacctccaaaaacttaaaagctttttcagagttaaacagctagtaagaggaaattgcaggatttggagccagctttgtccaactccagagctcatttttttctacttcttctccatgatcatttttaagaaaacctttctccctttcagaatggcttgatgatgagagtggttgaaataactttggaactgaaatcaagaactgggtgtcaaatgactgattcagggatataaaggccaagggctctctaaataatatcctgtacactaatctgtctctgtgcttgtcagggaattcaacagctaaataaaacctctctgtgcctcagtgtcctcatctggaaaatgggg

SEQ ID NO: 436433 - DNA, 2415 bp, Homo sapiens
actgtgcgcatgcgccccacccctgtcggcgactgctgccaccgctggcgccgctgtcggagctcagaccagcaggcctacgacctagaaagtgctcaaaaccccacttcctaaggcctagaaggagcgacgtgaagatataaggtctcactatgttgcccatgctggtttcaaactcctgggctcaagtgatcctcctgcctctgtcttccaaattgctgagattactggcatgagccattgcacctggccttcttttttgagatggcctcaggttggctctgcctggagagggggaagcttgtaaagatggcttagaaaaaaagtcctggctccatttctattttctcccttcttttgctggcctgtttcctgctttttgcaaattgcaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtgatggaaaacactatcaaacaatctgagaatgacctaaacaagctgctagagtctacaaggaggctgcatgatgagtataagccactgaaagaacatgtggatgccctgcgcatgactctgggcctgcagaggctccctgacttgtgtgaagaagaggagaagctttccttggattactttgagaagcagaaagcagaatggcagacagaacctcaggagccccccatccctgagtccctggccgctgcagccgctgccgcccaacagctccaagtggctaggaagcaggatactcggcagacggccaccttcaggcagcagcccccacctatgaaggcctgcttgtcatgtcaccagcaaattcaccggaatgcacctatatgccctctttgcaaggccaagagtcggtcccggaaccccaaaaagccgaaacggaagcaggatgaataaagaaagggagagcacatgaagctttgctaattataacccctcaccttgaccagagtcattgatgtcctgatgtgaaacaacccttgcccaaccccacgaagtctcctatttaatgtgatggaagcacaacccctctctcactttgctcctatttctttctgctcttgggatttctggtttaggaagagatgtggttcaggtgctaaacagtgtgtctgatgatcccttctctcccactcacatttcaacccctgcccttgtttggagctaagggaagggcaaaaggctcagatatgattctctatctcttgtgcctgaggcctggagcctaaggagctgtagggtctgaggggcaggggaggcccatatcttgtttcaggtaaaggacccagtatttcccctccttgtacttttgccttaggttctcaagggacaatagtcttcatgttggattctccaacaggctgggtgcatgtatccccctactcctaccctcatctcatccttaaggcccagaggtagcttggacaagccctccttttcataatcatttgggaggcatggctgtaattctttagctttctccacttctgtctcccacatatactaaaattcttaggtactaggctgtgtgtcttgggatcttaagatcaatgaacctttccccaatatctagtctttgcaaattctagtagaagatttccacagtgaaatcagtgagccagaccaactctacatctcctgcctaacctactgcctaagtcattagggctgagggctcggctgtaggggcttccttaggctgagagtgcccccaggctgacatctgtgttggcttttgttcagaaccattactctggcacatgctcaatggtatattgcagggaggagaggagtagatttagatttgagtaaatgccaatcactttacacatgaaggtgggtgggactttccttccattcatcccttgctctcttggatctgaactcttctggagcctcagctcaggatagctgctggccactcctgtcctgtggattgtgcaggtggcctttcctcccaaaagaaaaggcatcaggctccccaagccccacagctctcctttccaccaaagccaggtttcctggtaaggtcactcgaagataagggatggggatgggggctgactgacaaaaaattttagccccaggtctcagtacctggctggggagggggatatttttccttccttaagtagttttacattgccacagtgtgtatgtgttcactatataaaatgttcctctgctctttgaaagtaagagtgttgtgtctgtacaaatccttttaacatgcattcattggagtaaattctgagtatctactgtgtattggataatacaaaagatgtaatgtcattt

SEQ ID NO: 436434 - DNA, 2208 bp, Homo sapiens
  misc_feature (3)..(3): n is a, c, g, or t
  misc_feature (14)..(14): n is a, c, g, or t
  misc_feature (26)..(26): n is a, c, g, or t
canctaggctagtngaggcccgtgtnaatcggccgaggccaagcccggaggaggtggctacattgtgtctattgtatcccttggctggtgtatttgtacatctctcgggacgtgaaattgacagtgaaaagtatggcagatgagcaagaaatcatgtgcaaattggaaagcattaaagagatcaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtgatggaaaacactatcaaacaatctgagaatgacctaaacaagctgctagagtctacaaggaggctgcatgatgagtataagccactgaaagaacatgtggatgccctgcgcatgactctgggcctgcagaggctccctgacttgtgtgaagaagaggagaagctttccttggattactttgagaagcagaaagcagaatggcagacagaacctcaggagccccccatccctgagtccctggccgctgcagccgctgccgcccaacagctccaagtggctaggaagcaggatactcggcagacggccaccttcaggcagcagcccccacctatgaaggcctgcttgtcatgtcaccagcaaattcaccggaatgcacctatatgccctctttgcaaggccaagagtcggtcccggaaccccaaaaagccgaaacggaagcaggatgaataaagaaagggagagcacatgaagctttgctaattataacccctcaccttgaccagagtcattgatgtcctgatgtgaaacaacccttgcccaaccccacgaagtctcctatttaatgtgatggaagcacaacccctctctcactttgctcctatttctttctgctcttgggatttctggtttaggaagagatgtggttcaggtgctaaacagtgtgtctgatgatcccttctctcccactcacatttcaacccctgcccttgtttggagctaagggaagggcaaaaggctcagatatgattctctatctcttgtgcctgaggcctggagcctaaggagctgtagggtctgaggggcaggggaggcccatatcttgtttcaggtaaaggacccagtatttcccctccttgtacttttgccttaggttctcaagggacaatagtcttcatgttggattctccaacaggctgggtgcatgtatccccctactcctaccctcatctcatccttaaggcccagaggtagcttggacaagccctccttttcataatcatttgggaggcatggctgtaattctttagctttctccacttctgtctcccacatatactaaaattcttaggtactaggctgtgtgtcttgggatcttaagatcaatgaacctttccccaatatctagtctttgcaaattctagtagaagatttccacagtgaaatcagtgagccagaccaactctacatctcctgcctaacctactgcctaagtcattagggctgagggctcggctgtaggggcttccttaggctgagagtgcccccaggctgacatctgtgttggcttttgttcagaaccattactctggcacatgctcaatggtatattgcagggaggagaggagtagatttagatttgagtaaatgccaatcactttacacatgaaggtgggtgggactttccttccattcatcccttgctctcttggatctgaactcttctggagcctcagctcaggatagctgctggccactcctgtcctgtggattgtgcaggtggcctttcctcccaaaagaaaaggcatcaggctccccaagccccacagctctcctttccaccaaagccaggtttcctggtaaggtcactcgaagataagggatggggatgggggctgactgacaaaaaattttagccccaggtctcagtacctggctggggagggggatatttttccttccttaagtagttttacattgccacagtgtgtatgtgttcactatataaaatgttcctctgctctttgaaagtaagagtgttgtgtctgtacaaatccttttaacatgcattcattggagtaaattctgagtatctactgtgtattggataatacaaaagatgtaatgtcattt

SEQ ID NO: 436435 - DNA, 3043 bp, Homo sapiens
  misc_feature (3)..(3): n is a, c, g, or t
  misc_feature (14)..(14): n is a, c, g, or t
  misc_feature (26)..(26): n is a, c, g, or t
canctaggctagtngaggcccgtgtnaatcggccgaggccaagcccggaggaggtggctacattgtgtctattgtatcccttggctggtgtatttgtacatctctcgggacgtgaaattgacagtgaaaagtatggcagatgagcaagaaatcatgtgcaaattggaaagcattaaagagatcagatataaggtctcactatgttgcccatgctggtttcaaactcctgggctcaagtgatcctcctgcctctgtcttccaaattgctgagattactggcatgagccattgcacctggccttcttttttgagatggcctcaggttggctctgcctggagagggggaagcttgtaaagatggcttagaaaaaaagtcctggctccatttctattttctcccttcttttgctggcctgtttcctgctttttgcaaattgcaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtgatggaaaacactatcaaacaatctgagaatgacctaaacaagctgctagagtctacaaggaggctgcatgatgagtataagccactgaaagaacatgtggatgccctgcgcatgactctgggcctgcagaggctccctgacttgtgtgaagaagaggagaagctttccttggattactttgagaagcagaaagcagaatggcagacagaacctcaggagccccccatccctgagtccctggccgctgcagccgctgccgcccaacagctccaagtggctaggaagcaggatactcggcagacggccaccttcaggcagcagcccccacctatgaaggcctgcttgtcatgtcaccagcaaattcaccggaatgcacctatatgccctctttgcaaggccaagagtcggtcccggaaccccaaaaagccgaaacggaagcaggatgaataaagaaagggagagcacatgaagctttgctaattataacccctcaccttgaccagagtcattgatgtcctgatgtgaaacaacccttgcccaaccccacgaagtctcctatttaatgtgatggaagcacaacccctctctcactttgctcctatttctttctgctcttgggatttctggtttaggaagagatgtggttcaggtgctaaacagtgtgtctgatgatcccttctctcccactcacatttcaacccctgcccttgtttggagctaagggaagggcaaaaggctcagatatgattctctatctcttgtgcctgaggcctggagcctaaggagctgtagggtctgaggggcaggggaggcccatatcttgtttcaggtaaaggacccagtatttcccctccttgtacttttgccttaggttctcaagggacaatagtcttcatgttggattctccaacaggctgggtgcatgtatccccctactcctaccctcatctcatccttaaggcccagaggtagcttggacaagccctccttttcataatcatttgggaggcatggctgtaattctttagctttctccacttctgtctcccacatatactaaaattcttaggtactaggctgtgtgtcttgggatcttaagatcaatgaacctttccccaatatctagtctttgcaaattctagtagaagatttccacagtgaaatcagtgagccagaccaactctacatctcctgcctaacctactgcctaagtcattagggctgagggctcggctgtaggggcttccttaggctgagagtgcccccaggctgacatctgtgttggcttttgttcagaaccattactctggcacatgctcaatggtatattgcagggaggagaggagtagatttagatttgagtaaatgccaatcactttacacatgaaggtgggtgggactttccttccattcatcccttgctctcttggatctgaactcttctggagcctcagctcaggatagctgctggccactcctgtcctgtggattgtgcaggtggcctttcctcccaaaagaaaaggcatcaggctccccaagccccacagctctcctttccaccaaagccaggtttcctggtaaggtcactcgaagataagggatggggatgggggctgactgacaaaaaattttagccccaggtctcagtacctggctggggagggggatatttttccttccttaagtagttttacattgccacagtgtgtatgtgttcactatataaaatgttcctctgctctttgaaagtaagagtgttgtgtctgtacaaatccttttaacatgcattcattggagtaaattctgagtatctactgtgtattggataatacaaaagatgtaatgtcatttacctttctgggtagctcttgtttgctcttattcattccaccttacaaatgagaaagccaggcaccaaggacaataatttacctaattatcacaataatttccatttatttagcacctactctgtgccaggtacctatgcaagttgcttaatataaatgattgtatttgacttccaaaataccttacaagctaagtattcttatcaccattttaaaaaaaaagggatactgaacctccaaaaacttaaaagctttttcagagttaaacagctagtaagaggaaattgcaggatttggagccagctttgtccaactccagagctcatttttttctacttcttctccatgatcatttttaagaaaacctttctccctttcagaatggcttgatgatgagagtggttgaaataactttggaactgaaatcaagaactgggtgtcaaatgactgattcagggatataaaggccaagggctctctaaataatatcctgtacactaatctgtctctgtgcttgtcagggaattcaacagctaaataaaacctctctgtgcctcagtgtcctcatctggaaaatgggg

SEQ ID NO: 436436 - DNA, 2740 bp, Homo sapiens
actgtgcgcatgcgccccacccctgtcggcgactgctgccaccgctggcgccgctgtcggagctcagaccagcaggcctacgacctagaaagtgctcaaaaccccacttcctaaggcctagaaggagcgacgtgaaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtgatggaaaacactatcaaacaatctgagaatgacctaaacaagctgctagagtctacaaggaggctgcatgatgagtataagccactgaaagaacatgtggatgccctgcgcatgactctgggcctgcagaggctccctgacttgtgtgaagaagaggagaagctttccttggattactttgagaagcagaaagcagaatggcagacagaacctcaggagccccccatccctgagtccctggccgctgcagccgctgccgcccaacagctccaagtggctaggaagcaggatactcggcagacggccaccttcaggcagcagcccccacctatgaaggcctgcttgtcatgtcaccagcaaattcaccggaatgcacctatatgccctctttgcaaggccaagagtcggtcccggaaccccaaaaagccgaaacggaagcaggatgaataaagaaagggagagcacatgaagctttgctaattataacccctcaccttgaccagagtcattgatgtcctgatgtgaaacaacccttgcccaaccccacgaagtctcctatttaatgtgatggaagcacaacccctctctcactttgctcctatttctttctgctcttgggatttctggtttaggaagagatgtggttcaggtgctaaacagtgtgtctgatgatcccttctctcccactcacatttcaacccctgcccttgtttggagctaagggaagggcaaaaggctcagatatgattctctatctcttgtgcctgaggcctggagcctaaggagctgtagggtctgaggggcaggggaggcccatatcttgtttcaggtaaaggacccagtatttcccctccttgtacttttgccttaggttctcaagggacaatagtcttcatgttggattctccaacaggctgggtgcatgtatccccctactcctaccctcatctcatccttaaggcccagaggtagcttggacaagccctccttttcataatcatttgggaggcatggctgtaattctttagctttctccacttctgtctcccacatatactaaaattcttaggtactaggctgtgtgtcttgggatcttaagatcaatgaacctttccccaatatctagtctttgcaaattctagtagaagatttccacagtgaaatcagtgagccagaccaactctacatctcctgcctaacctactgcctaagtcattagggctgagggctcggctgtaggggcttccttaggctgagagtgcccccaggctgacatctgtgttggcttttgttcagaaccattactctggcacatgctcaatggtatattgcagggaggagaggagtagatttagatttgagtaaatgccaatcactttacacatgaaggtgggtgggactttccttccattcatcccttgctctcttggatctgaactcttctggagcctcagctcaggatagctgctggccactcctgtcctgtggattgtgcaggtggcctttcctcccaaaagaaaaggcatcaggctccccaagccccacagctctcctttccaccaaagccaggtttcctggtaaggtcactcgaagataagggatggggatgggggctgactgacaaaaaattttagccccaggtctcagtacctggctggggagggggatatttttccttccttaagtagttttacattgccacagtgtgtatgtgttcactatataaaatgttcctctgctctttgaaagtaagagtgttgtgtctgtacaaatccttttaacatgcattcattggagtaaattctgagtatctactgtgtattggataatacaaaagatgtaatgtcatttacctttctgggtagctcttgtttgctcttattcattccaccttacaaatgagaaagccaggcaccaaggacaataatttacctaattatcacaataatttccatttatttagcacctactctgtgccaggtacctatgcaagttgcttaatataaatgattgtatttgacttccaaaataccttacaagctaagtattcttatcaccattttaaaaaaaaagggatactgaacctccaaaaacttaaaagctttttcagagttaaacagctagtaagaggaaattgcaggatttggagccagctttgtccaactccagagctcatttttttctacttcttctccatgatcatttttaagaaaacctttctccctttcagaatggcttgatgatgagagtggttgaaataactttggaactgaaatcaagaactgggtgtcaaatgactgattcagggatataaaggccaagggctctctaaataatatcctgtacactaatctgtctctgtgcttgtcagggaattcaacagctaaataaaacctctctgtgcctcagtgtcctcatctggaaaatgggg

SEQ ID NO: 436437 - DNA, 2051 bp, Homo sapiens
  misc_feature (7)..(11): n is a, c, g, or t
aggggannnnnagaaacatacggctaggtacgaggctgggtggtcaagcccggaggaggtggctacattgtgtctattgtatcccttggctggtgtatttgtacatctctcgggacgtgaaattgacagtgaaaagtatggcagatgagcaagaaatcatgtgcaaattggaaagcattaaagagatcaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtgatggaaaacactatcaaacaatctgagaatgacctaaacaagctgctagagtctacaaggaggctgcatgatgagtataagccactgaaagaacatgtggatgccctgcgcatgactctgggcctgcagaggctccctgacttgtgtgaagaagaggagaagctttccttggattactttgagaagcagaaagcagaatggcagacagaacctcaggagccccccatccctgagtccctggccgctgcagccgctgccgcccaacagctccaagtggctaggaagcaggatactcggcagacggccaccttcaggcagcagcccccacctatgaaggcctgcttgtcatgtcaccagcaaattcaccggaatgcacctatatgccctctttgcaaggccaagagtcggtcccggaaccccaaaaagccgaaacggaagcaggatgaataaagaaagggagagcacatgaagctttgctaattataacccctcaccttgaccagagtcattgatgtcctgatgtgaaacaacccttgcccaaccccacgaagtctcctatttaatgtgatggaagcacaacccctctctcactttgctcctatttctttctgctcttgggatttctggtttaggaagagatgtggttcaggtgctaaacagtgtgtctgatgatcccttctctcccactcacatttcaacccctgcccttgtttggagctaagggaagggcaaaaggctcagatatgattctctatctcttgtgcctgaggcctggagcctaaggagctgtagggtctgaggggcaggggaggcccatatcttgtttcaggtaaaggacccagtatttcccctccttgtacttttgccttaggttctcaagggacaatagtcttcatgttggattctccaacaggctgggtgcatgtatccccctactcctaccctcatctcatccttaaggcccagaggtagcttggacaagccctccttttcataatcatttgggaggcatggctgtaattctttagctttctccacttctgtctcccacatatactaaaattcttaggtactaggctgtgtgtcttgggatcttaagatcaatgaacctttccccaatatctagtctttgcaaattctagtagaagatttccacagtgaaatcagtgagccagaccaactctacatctcctgcctaacctactgcctaagtcattagggctgagggctcggctgtaggggcttccttaggctgagagtgcccccaggctgacatctgtgttggcttttgttcagaaccattactctggcacatgctcaatggtatattgcagggaggagaggagtagatttagatttgagtaaatgccaatcactttacacatgaaggtgggtgggactttccttccattcatcccttgctctcttggatctgaactcttctggagcctcagctcaggatagctgctggccactcctgtcctgtggattgtgcaggtggcctttcctcccaaaagaaaaggcatcaggctccccaagccccacagctctcctttccaccaaagccaggtttcctggtaaggtcactcgaagataagggatgggatgaaagcactcgatatgaatcatatccagcgccttcatgccgtggtaaattgcttttgtaagttgtattgggggtaccgagct

SEQ ID NO: 436438 - DNA, 3387 bp, Homo sapiens
agcacagctgcaccgccgagctgcgagcggctgcgagcgagagagcgtaagagcaagagagctagagagcgagcaacgggcactcgccccacgcctcccctcagccccaccgcgcgctccgcttgcctctccaccccgcccgactctacccggcccggtccctgcgcgggcacagcccagagctctggggcggtgcaggcagcctcgggactctccggcgcgccgccgcgtccccagacaaaggcttggccggcggccccggcccgctgcgccctcgctccccgcctccccagctcttctccgctcttcccccccgcgcttggctcggcgcgctccggccggccgcaaagtttcccgggcggcagcggcggctgcgcctcgcttcagcgatggccgcggagctgagcatggggccagagctgcccaccagcccgctggccatggagtatgtcaacgacttcgacctgctcaagttcgacgtgaagaaggagccactggggcgcgcggagcgtccgggcaggccctgcacacgcctgcagccagccggctcggtgtcctccacaccgctcagcactccgtgtagctccgtgccctcgtcgcccagcttcagcccgaccgaacagaagacacacctcgaggatctgtactggatggcgagcaactaccagcagatgaaccccgaggcgctcaacctgacgcccgaggacgcggtggaagcgctcatcggctcgcacccagtgccacagccgctgcaaagcttcgacagctttcgcggcgctcaccaccaccaccatcaccaccaccctcacccgcaccacgcgtacccgggcgccggcgtggcccacgacgagctgggcccgcacgctcacccgcaccatcaccatcatcaccaagcgtcgccgccgccgtccagcgccgctagcccggcgcaacagctgcccactagccaccccgggcccgggccgcacgcgacggcctcggcgacggcggcgggcggcaacggcagcgtggaggaccgcttctccgacgaccagctcgtgtccatgtccgtgcgcgagctgaaccgccacctgcggggcttcaccaaggacgaggtgatccgcctgaagcagaagcggcggaccctgaagaaccggggctacgcccagtcttgcaggtataaacgcgtccagcagaagcaccacctggagaatgagaagacgcagctcattcagcaggtggagcagcttaagcaggaggtgtcccggctggcccgcgagagagacgcctacaaggtcaagtgcgagaaactcgccaactccggcttcagggaggcgggctccaccagcgacagcccctcctctcccgagttctttctgtgagtcgtggccggtcctggcccccgcccttgccccggcccggactccctgtcccacgtccctagtcccagactaccccggaccctgtccctgccgcggccccagccttgacctgtttgacttgagcgagagggaggaagggcgcgcgggccgcgggcgacgggcgggtgcgcgggcgggcaggggaccttggctaaggcgagagtagcgcacgccagcgccgcctcctagactcgagcagagccggagagagagacgagagggtgggaggtcccggagtaacttctctccaggctgaagggcggcgaggcatagtcccgagaagtcaccaaggccatctggagactcctggctttctgaactttgcgcgttaagccgggacagctgctttgctgcccggagagtagtccgcgccaggaagagagcaacgaggaaaggagagggactctggcgtcccggcaggcgagaggcgaggctgagcgaaagaaggaaggacagacggacctgtctgtcagagttcggagaacactggctctcagccctgagacacaggcctcagttaggacgctcggcgcccaaatctcatcagttttattgcctgctcgattatatagaaaaatacaaaaaatctgcattaaaaatattaatcctgcatgctggacatgtatggtaataatttctattttgtaccattttcttgtttaactttagcatgttgttgatcatggatcatactccccttgtttctttgggtgagaagggatcgcagtttggaaactccggcggctgcgtgcggggtttcagtcccagctgtaggcttgtaaatacccgccccgccaaaccgcatagagaacgtggcagcaagctgagggtctttgtttgggtttattattacggtatttttgtttgtaagttaaaaagaaaaaaaaaaagaaaaagttccgggcattttgcatcagaaaacaactttgtcttggggcacacttggaagttgcatgttttctttccttcccttatccccattcggtcctctttttcctctctcgctttagttttcaaccttgttggtgctgagagagagaaccgagaggtcccagtacaagggcagggcagggcagggaagctgccaagctccgcaccccagaggagtgttctggactacagccttgtcttatggtcaaattgatacccttaataagaaaggaaaggaaaggaaaacagatcctcccctctgctttttattgtaaccagaatcaccctgaggtcccttctgaaccctctgggcctgcgctaattgtaggagccacagcgctcctagggtgagaggcttagccatccctgaccctggcagtgcactggtaagcagacactgcactgaaccaactgctatgctcagaatgtaccagaaacccaaacattggcaagtaattttgcaactttcaagtgcgttctttagaccaatgcattgcgtttctttccctgcttttgagatagtaggaagagttcttggtggtgtccccccccttcaattcttcagttgtatagtagttatagggaagatatgggtgtttttctttattattacttttttttttctgcaggtcagtaaaaggatttaagttgcactgacaaaaataccaaaataaaagtgtatttttaagttcccatttgaaattgctggcgctgctggccggatgcatttttgagtttgtattagttgataaattaacagtaataacaagattgtatgaaccgcatggtgcttgcagttttaaatattgtggatatttgtcctgcatcagaaacgagctttggtttttacagattcaactgtgttgaaatcaaacctgccgcaacagaaattgtttttatttcatgtaaaataagggatcaatttcaaaccctgcttatgatatgaaaatattaaaacctagtctattgtagttttattcagactggtttctgttttttggttattaaaatggtttcctattttgcttattaaaaccatggaaatggtgtttattta

SEQ ID NO: 436439 - DNA, 3254 bp, Homo sapiens
agcacagctgcaccgccgagctgcgagcggctgcgagcgagagagcgtaagagcaagagagctagagagcgagcaacgggcactcgccccacgcctcccctcagccccaccgcgcgctccgcttgcctctccaccccgcccgactctacccggcccggtccctgcgcgggcacagcccagagctctggggcggtgcaggcagcctcgggactctccggcgcgccgccgcgtccccagacaaaggcttggccggcggccccggcccgctgcgccctcgctccccgcctccccagctcttctccgctcttcccccccgcgcttggctcggcgcgctccggccggccgcaaagtttcccgggcggcagcggcggctgcgcctcgcttcagcgatggccgcggagctgagcatggggccagagctgcccaccagcccgctggccatggagtatgtcaacgacttcgacctgctcaagttcgacgtgaagaaggagccactggggcgcgcggagcgtccgggcaggccctgcacacgcctgcagccagccggctcggtgtcctccacaccgctcagcactccgtgtagctccgtgccctcgtcgcccagcttcagcccgaccgaacagaagacacacctcgaggatctgtactggatggcgagcaactaccagcagatgaaccccgaggcgctcaacctgacgcccgaggacgcggtggaagcgctcatcggctcgcacccagtgccacagccgctgcaaagcttcgacagctttcgcggcgctcaccaccaccaccatcaccaccaccctcacccgcaccacgcgtacccgggcgccggcgtggcccacgacgagctgggcccgcacgctcacccgcaccatcaccatcatcaccaagcgtcgccgccgccgtccagcgccgctagcccggcgcaacagctgcccactagccaccccgggcccgggccgcacgcgacggcctcggcgacggcggcgggcggcaacggcagcgtggaggaccgcttctccgacgaccagctcgtgtccatgtccgtgcgcgagctgaaccgccacctgcggggcttcaccaaggacgaggtgatccgcctgaagcagaagcggcggaccctgaagaaccggggctacgcccagtcttgcaggtataaacgcgtccagcagaagcaccacctggagaatgagaagacgcagctcattcagcaggtggagcagcttaagcaggaggtgtcccggctggcccgcgagagagacgcctacaaggtcaagtgcgagaaactcgccaactccggcttcagggaggcgggctccaccagcgacagcccctcctctcccgagttctttctgtgagtcgtggccggtcctggccccagccttgacctgtttgacttgagcgagagggaggaagggcgcgcgggccgcgggcgacgggcgggtgcgcgggcgggcaggggaccttggctaaggcgagagtagcgcacgccagcgccgcctcctagactcgagcagagccggagagagagacgagagggtgggaggtcccggagtaacttctctccaggctgaagggcggcgaggcatagtcccgagaagtcaccaaggccatctggagactcctggctttctgaactttgcgcgttaagccgggacagctgctttgctgcccggagagtagtccgcgccaggaagagagcaacgaggaaaggagagggactctggcgtcccggcaggcgagaggcgaggctgagcgaaagaaggaaggacagacggacctgtctgtcagagttcggagaacactggctctcagccctgagacacaggcctcagttaggacgctcggcgcccaaatctcatcagttttattgcctgctcgattatatagaaaaatacaaaaaatctgcattaaaaatattaatcctgcatgctggacatgtatggtaataatttctattttgtaccattttcttgtttaactttagcatgttgttgatcatggatcatactccccttgtttctttgggtgagaagggatcgcagtttggaaactccggcggctgcgtgcggggtttcagtcccagctgtaggcttgtaaatacccgccccgccaaaccgcatagagaacgtggcagcaagctgagggtctttgtttgggtttattattacggtatttttgtttgtaagttaaaaagaaaaaaaaaaagaaaaagttccgggcattttgcatcagaaaacaactttgtcttggggcacacttggaagttgcatgttttctttccttcccttatccccattcggtcctctttttcctctctcgctttagttttcaaccttgttggtgctgagagagagaaccgagaggtcccagtacaagggcagggcagggcagggaagctgccaagctccgcaccccagaggagtgttctggactacagccttgtcttatggtcaaattgatacccttaataagaaaggaaaggaaaggttctgaaccctctgggcctgcgctaattgtaggagccacagcgctcctagggtgagaggcttagccatccctgaccctggcagtgcactggtaagcagacactgcactgaaccaactgctatgctcagaatgtaccagaaacccaaacattggcaagtaattttgcaactttcaagtgcgttctttagaccaatgcattgcgtttctttccctgcttttgagatagtaggaagagttcttggtggtgtccccccccttcaattcttcagttgtatagtagttatagggaagatatgggtgtttttctttattattacttttttttttctgcaggtcagtaaaaggatttaagttgcactgacaaaaataccaaaataaaagtgtatttttaagttcccatttgaaattgctggcgctgctggccggatgcatttttgagtttgtattagttgataaattaacagtaataacaagattgtatgaaccgcatggtgcttgcagttttaaatattgtggatatttgtcctgcatcagaaacgagctttggtttttacagattcaactgtgttgaaatcaaacctgccgcaacagaaattgtttttatttcatgtaaaataagggatcaatttcaaaccctgcttatgatatgaaaatattaaaacctagtctattgtagttttattcagactggtttctgttttttggttattaaaatggtttcctattttgcttattaaaaccatggaaatggtgtttattta

SEQ ID NO: 436440 - DNA, 3308 bp, Homo sapiens
agcacagctgcaccgccgagctgcgagcggctgcgagcgagagagcgtaagagcaagagagctagagagcgagcaacgggcactcgccccacgcctcccctcagccccaccgcgcgctccgcttgcctctccaccccgcccgactctacccggcccggtccctgcgcgggcacagcccagagctctggggcggtgcaggcagcctcgggactctccggcgcgccgccgcgtccccagacaaaggcttggccggcggccccggcccgctgcgccctcgctccccgcctccccagctcttctccgctcttcccccccgcgcttggctcggcgcgctccggccggccgcaaagtttcccgggcggcagcggcggctgcgcctcgcttcagcgatggccgcggagctgagcatggggccagagctgcccaccagcccgctggccatggagtatgtcaacgacttcgacctgctcaagttcgacgtgaagaaggagccactggggcgcgcggagcgtccgggcaggccctgcacacgcctgcagccagccggctcggtgtcctccacaccgctcagcactccgtgtagctccgtgccctcgtcgcccagcttcagcccgaccgaacagaagacacacctcgaggatctgtactggatggcgagcaactaccagcagatgaaccccgaggcgctcaacctgacgcccgaggacgcggtggaagcgctcatcggctcgcacccagtgccacagccgctgcaaagcttcgacagctttcgcggcgctcaccaccaccaccatcaccaccaccctcacccgcaccacgcgtacccgggcgccggcgtggcccacgacgagctgggcccgcacgctcacccgcaccatcaccatcatcaccaagcgtcgccgccgccgtccagcgccgctagcccggcgcaacagctgcccactagccaccccgggcccgggccgcacgcgacggcctcggcgacggcggcgggcggcaacggcagcgtggaggaccgcttctccgacgaccagctcgtgtccatgtccgtgcgcgagctgaaccgccacctgcggggcttcaccaaggacgaggtgatccgcctgaagcagaagcggcggaccctgaagaaccggggctacgcccagtcttgcaggtataaacgcgtccagcagaagcaccacctggagaatgagaagacgcagctcattcagcaggtggagcagcttaagcaggaggtgtcccggctggcccgcgagagagacgcctacaaggtcaagtgcgagaaactcgccaactccggcttcagggaggcgggctccaccagcgacagcccctcctctcccgagttctttctgtgagtcgtggccggtcctggccccagccttgacctgtttgacttgagcgagagggaggaagggcgcgcgggccgcgggcgacgggcgggtgcgcgggcgggcaggggaccttggctaaggcgagagtagcgcacgccagcgccgcctcctagactcgagcagagccggagagagagacgagagggtgggaggtcccggagtaacttctctccaggctgaagggcggcgaggcatagtcccgagaagtcaccaaggccatctggagactcctggctttctgaactttgcgcgttaagccgggacagctgctttgctgcccggagagtagtccgcgccaggaagagagcaacgaggaaaggagagggactctggcgtcccggcaggcgagaggcgaggctgagcgaaagaaggaaggacagacggacctgtctgtcagagttcggagaacactggctctcagccctgagacacaggcctcagttaggacgctcggcgcccaaatctcatcagttttattgcctgctcgattatatagaaaaatacaaaaaatctgcattaaaaatattaatcctgcatgctggacatgtatggtaataatttctattttgtaccattttcttgtttaactttagcatgttgttgatcatggatcatactccccttgtttctttgggtgagaagggatcgcagtttggaaactccggcggctgcgtgcggggtttcagtcccagctgtaggcttgtaaatacccgccccgccaaaccgcatagagaacgtggcagcaagctgagggtctttgtttgggtttattattacggtatttttgtttgtaagttaaaaagaaaaaaaaaaagaaaaagttccgggcattttgcatcagaaaacaactttgtcttggggcacacttggaagttgcatgttttctttccttcccttatccccattcggtcctctttttcctctctcgctttagttttcaaccttgttggtgctgagagagagaaccgagaggtcccagtacaagggcagggcagggcagggaagctgccaagctccgcaccccagaggagtgttctggactacagccttgtcttatggtcaaattgatacccttaataagaaaggaaaggaaaggaaaacagatcctcccctctgctttttattgtaaccagaatcaccctgaggtcccttctgaaccctctgggcctgcgctaattgtaggagccacagcgctcctagggtgagaggcttagccatccctgaccctggcagtgcactggtaagcagacactgcactgaaccaactgctatgctcagaatgtaccagaaacccaaacattggcaagtaattttgcaactttcaagtgcgttctttagaccaatgcattgcgtttctttccctgcttttgagatagtaggaagagttcttggtggtgtccccccccttcaattcttcagttgtatagtagttatagggaagatatgggtgtttttctttattattacttttttttttctgcaggtcagtaaaaggatttaagttgcactgacaaaaataccaaaataaaagtgtatttttaagttcccatttgaaattgctggcgctgctggccggatgcatttttgagtttgtattagttgataaattaacagtaataacaagattgtatgaaccgcatggtgcttgcagttttaaatattgtggatatttgtcctgcatcagaaacgagctttggtttttacagattcaactgtgttgaaatcaaacctgccgcaacagaaattgtttttatttcatgtaaaataagggatcaatttcaaaccctgcttatgatatgaaaatattaaaacctagtctattgtagttttattcagactggtttctgttttttggttattaaaatggtttcctattttgcttattaaaaccatggaaatggtgtttattta

SEQ ID NO: 436441 - DNA, 2939 bp, Homo sapiens
ctcggtgtctccacaccgctcagcactccgtgtatgctccgtgcctggctggctgcaggagcgtccgggcaggccctgcacacgcctgcagccagccggctcggtgtcctccacaccgctcagcactccgtgtagctccgtgccctcgtcgcccagcttcagcccgaccgaacagaagacacacctcgaggatctgtactggatggcgagcaactaccagcagatgaaccccgaggcgctcaacctgacgcccgaggacgcggtggaagcgctcatcggctcgcacccagtgccacagccgctgcaaagcttcgacagctttcgcggcgctcaccaccaccaccatcaccaccaccctcacccgcaccacgcgtacccgggcgccggcgtggcccacgacgagctgggcccgcacgctcacccgcaccatcaccatcatcaccaagcgtcgccgccgccgtccagcgccgctagcccggcgcaacagctgcccactagccaccccgggcccgggccgcacgcgacggcctcggcgacggcggcgggcggcaacggcagcgtggaggaccgcttctccgacgaccagctcgtgtccatgtccgtgcgcgagctgaaccgccacctgcggggcttcaccaaggacgaggtgatccgcctgaagcagaagcggcggaccctgaagaaccggggctacgcccagtcttgcaggtataaacgcgtccagcagaagcaccacctggagaatgagaagacgcagctcattcagcaggtggagcagcttaagcaggaggtgtcccggctggcccgcgagagagacgcctacaaggtcaagtgcgagaaactcgccaactccggcttcagggaggcgggctccaccagcgacagcccctcctctcccgagttctttctgtgagtcgtggccggtcctggcccccgcccttgccccggcccggactccctgtcccacgtccctagtcccagactaccccggaccctgtccctgccgcggccccagccttgacctgtttgacttgagcgagagggaggaagggcgcgcgggccgcgggcgacgggcgggtgcgcgggcgggcaggggaccttggctaaggcgagagtagcgcacgccagcgccgcctcctagactcgagcagagccggagagagagacgagagggtgggaggtcccggagtaacttctctccaggctgaagggcggcgaggcatagtcccgagaagtcaccaaggccatctggagactcctggctttctgaactttgcgcgttaagccgggacagctgctttgctgcccggagagtagtccgcgccaggaagagagcaacgaggaaaggagagggactctggcgtcccggcaggcgagaggcgaggctgagcgaaagaaggaaggacagacggacctgtctgtcagagttcggagaacactggctctcagccctgagacacaggcctcagttaggacgctcggcgcccaaatctcatcagttttattgcctgctcgattatatagaaaaatacaaaaaatctgcattaaaaatattaatcctgcatgctggacatgtatggtaataatttctattttgtaccattttcttgtttaactttagcatgttgttgatcatggatcatactccccttgtttctttgggtgagaagggatcgcagtttggaaactccggcggctgcgtgcggggtttcagtcccagctgtaggcttgtaaatacccgccccgccaaaccgcatagagaacgtggcagcaagctgagggtctttgtttgggtttattattacggtatttttgtttgtaagttaaaaagaaaaaaaaaaagaaaaagttccgggcattttgcatcagaaaacaactttgtcttggggcacacttggaagttgcatgttttctttccttcccttatccccattcggtcctctttttcctctctcgctttagttttcaaccttgttggtgctgagagagagaaccgagaggtcccagtacaagggcagggcagggcagggaagctgccaagctccgcaccccagaggagtgttctggactacagccttgtcttatggtcaaattgatacccttaataagaaaggaaaggaaaggaaaacagatcctcccctctgctttttattgtaaccagaatcaccctgaggtcccttctgaaccctctgggcctgcgctaattgtaggagccacagcgctcctagggtgagaggcttagccatccctgaccctggcagtgcactggtaagcagacactgcactgaaccaactgctatgctcagaatgtaccagaaacccaaacattggcaagtaattttgcaactttcaagtgcgttctttagaccaatgcattgcgtttctttccctgcttttgagatagtaggaagagttcttggtggtgtccccccccttcaattcttcagttgtatagtagttatagggaagatatgggtgtttttctttattattacttttttttttctgcaggtcagtaaaaggatttaagttgcactgacaaaaataccaaaataaaagtgtatttttaagttcccatttgaaattgctggcgctgctggccggatgcatttttgagtttgtattagttgataaattaacagtaataacaagattgtatgaaccgcatggtgcttgcagttttaaatattgtggatatttgtcctgcatcagaaacgagctttggtttttacagattcaactgtgttgaaatcaaacctgccgcaacagaaattgtttttatttcatgtaaaataagggatcaatttcaaaccctgcttatgatatgaaaatattaaaacctagtctattgtagttttattcagactggtttctgttttttggttattaaaatggtttcctattttgcttattaaaaccatggaaatggtgtttattta

SEQ ID NO: 436442 - DNA, 1708 bp, Homo sapiens
gatcccgcccccctcggagcgcccctgtggtctgacttcagcagcactttccggcaggagactgggcactcgctgtcacccgcgagctgcctccctcagcgagatctgagcatctttccggaggctaacagacctgggcttcggggtgaccactgtgcttgcctcagtttccttttctggagcaggggaaggcccggctccctgcccaaaggcggctgtgcgctaagtggcagacgctcggggagagccggcgcggggcggaccccagcgccagtagtgacaggggcgaacgccgccgggagactccagccggcgggcgagcaggcctgtcgttgctggtggcggcatggtcttctgtctgtcgagcgaggagccgcgccgcccgctgcgaagcgacatggtccacttccaggcctcggaagtccagcagctgctacacaacaagttcgtggtcatcttgggggactccattcagagggctgtgtacaaggacctggtgctcttgctccagaaagactcactgctcacagctgcccagctgaaagccaagagtaccttgaggatgttctggaagagctgacatatggacctgccccggacctggtgatcatcaactcctgcctctgggatctctccagatatggtcgctgctcaatggagagctaccgggagaacctggagcgggtgtttgtgcgcatggaccaagtattgccagactcctgcctgctggtgtggaacatggcgatgcccctcggggaacgtatcactgggggtttcctcctgccagagctccagcccctggcaggctccctgcggcgggatgtggttgaagggaacttctacagtgctacgctggccggggaccactgctttgatgtcctagacctccactttcacttccggcatgcagtacagcaccgtcatcgggatggtgtccactgggaccagcatgcacaccgccacctctcacacctgcttctgacccatgtggctgacgcctggggcgtggagctgcccaagcgtggctatccccctgacccgtggattgaggactgggcagagatgaatcatccattccagggaagccataggcagaccccagacttcggggagcacctggccttgctcccacccccaccttcttctttgcctcctcccatgccttttccctacccgcttcctcagccctcgccacctcccctcttcccacccctgccccaggataccccttttttcccaggccagcccttcccaccccatgaattcttcaactataatccagtggaggacttctcgatgccaccccacttaggatgtggccctggagtgaactttgtgcctggccctctgccacctccaatccctggccctaatccccatggtcagcactggggcccagtggtccaccgggggatgccacgctatgttcctaacagcccctaccatgtgcggagaatgggggggccctgcaggcagcggctcagacactcagagagactgatccacacatacaaactggacagacggcctcctgcccattcggggacatggcctgggtagactggatcttgggctgggactggatgtgccaatggcccttcagggcctgcctggcacctcaggtactgggctagggtgtctgctatgcctggtattgttcttgtccattgctgtcaccaataaaggcatggaagaacagagtgacaaa

SEQ ID NO: 436443 - DNA, 486 bp, Homo sapiens
ctctctctgtggggccaggaatctatggggctgggtttctaccatctccagctggctgagaagtagcagccaaacaggagctagttcttgcaaaagtgggggctgtctcaggactcctcttttccaacaatatccataccttcctcactcctcagtcccagactcaggccctggaggttttggaagagcccctccgacgctctcaatgggggggccctgcaggcagcggctcagacactcagagagactgatccacacatccgtactggcccggacgctctctctgtgggggaagctctctctgtgggggacgctctctctgtggggggaaagagaaggaccctgcttgaccgcgacaggtccccttgtatcctgttccctctccatcttattttctccacagtgctctagggcagctgtggagccaatgatgaaaaccacatgtttctggcagccctgctgtgcaccagtgcccccacagagaga

SEQ ID NO: 436444 - DNA, 2008 bp, Homo sapiens
cacgtggcgaggccgccgccgcggccatcaccactgtgggcagcctcacttggctgccgccccgagaccccagcccgtacctgggcttcgcgcccgccaagtgggcccagccctggctcctgcgccctgtggcggccacctccatcgccttgctttcccttcgggcactgggggtcgctcagggcgggacatgggtgaacggaagtggaagctgtgagcgtcgcagcccgaggcgccgaggcctgaggcgccgtcggggccaccgcgacgctcgcatggagagcgctgggcgctgggctgtgcaccgacggctaacctggacccacggtctctgcggggcgggagctttgcagaaccgactggccgactggggcgcgggaacatgaggcttggctaggagcccgctgcgggccaggcgcgcggtgcgcaggcatacccgggtcgcgggtgaacaccgcggagccccgggacttgcctgtcgttgctggtggcggcatggtcttctgtctgtcgagcgaggagccgcgccgcccgctgcgaagcgacatggtccacttccaggcctcggaagtccagcagctgctacacaacaagttcgtggtcatcttgggggactccattcagagggctgtgtacaaggacctggtgctcttgctccagaaagactcactgctcacagctgcccagctgaaagccaagggggagctgagctttgaacaggaccagctggtggctgggggccagctgggcgagctgcacaacgggacacagtatcgtgaggtccgccagttctgctcgggctctggccaccaccttgtgcgcttctacttcctcactcgtgtttactccgagtaccttgaggatgttctggaagagctgacatatggacctgccccggacctggtgatcatcaactcctgcctctgggatctctccagatatggtcgctgctcaatggagagctaccgggagaacctggagcgggtgtttgtgcgcatggaccaagtattgccagactcctgcctgctggtgtggaacatggcgatgcccctcggggaacgtatcactgggggtttcctcctgccagagctccagcccctggcaggctccctgcggcgggatgtggttgaagggaacttctacagtgctacgctggccggggaccactgctttgatgtcctagacctccactttcacttccggcatgcagtacagcaccgtcatcgggatggtgtccactgggaccagcatgcacaccgccacctctcacacctgcttctgacccatgtggctgacgcctggggcgtggagctgcccaagcgtggctatccccctgacccgtggattgaggactgggcagagatgaatcatccattccagggaagccataggcagaccccagacttcggggagcacctggccttgctcccacccccaccttcttctttgcctcctcccatgccttttccctacccgcttcctcagccctcgccacctcccctcttcccacccctgccccaggataccccttttttcccaggccagcccttcccaccccatgaattcttcaactataatccagtggaggacttctcgatgccaccccacttaggatgtggccctggagtgaactttgtgcctggccctctgccacctccaatccctggccctaatccccatggtcagcactggggcccagtggtccaccgggggatgccacgctatgttcctaacagcccctaccatgtgcggagaatgggggggccctgcaggcagcggctcagacactcagagagactgatccacacatacaaactggacagacggcctcctgcccattcggggacatggcctgggtagactggatcttgggctgggactggatgtgccaatggcccttcagggcctgcctggcacctcaggtactgggctagggtgtctgctatgcctggtattgttcttgtccattgctgtcaccaataaaggcatggaagaacagagtgacaaa

SEQ ID NO: 436445 - DNA, 2337 bp, Homo sapiens
cacgtggcgaggccgccgccgcggccatcaccactgtgggcagcctcacttggctgccgccccgagaccccagcccgtacctgggcttcgcgcccgccaagtgggcccagccctggctcctgcgccctgtggcggccacctccatcgccttgctttcccttcgggcactgggggtcgctcagggcgggacatgggtgaacggaagtggaagctgtgagcgtcgcagcccgaggcgccgaggcctgaggcgccgtcggggccaccgcgacgctcgcatggagagcgctgggcgctgggctgtgcaccgacggctaacctggacccacggtctctgcggggcgggagctttgcagaaccgactggccgactggggcgcgggaacatgaggcttggctaggagcccgctgcgggccaggcgcgcggtgcgcaggcatacccgggtcgcgggtgaacaccgcggagccccgggacttgcctgtcgttgctggtggcggcatggtcttctgtctgtcgagcgaggagccgcgccgcccgctgcgaagcgacatggtccacttccaggcctcggaagtccagcagctgctacacaacaagttcgtggtcatcttgggggactccattcagagggctgtgtacaaggacctggtgctcttgctccagaaagactcactgctcacagctgcccagctgaaagccaagggggagctgagctttgaacaggaccagctggtggctgggggccagctgggcgagctgcacaacgggacacagtatcgtgaggtccgccagttctgctcgggctctggccaccaccttgtgcgcttctacttcctcactcgtgtttactccgagtaccttgaggatgttctggaagagctgacatatggacctgccccggacctggtgatcatcaactcctgcctctgggatctctccagatatggtcgctgctcaatggagagctaccgggagaacctggagcgggtgtttgtgcgcatggaccaagtattgccagactcctgcctgctggtgtggaacatggcgatgcccctcggggaacgtatcactgggggtttcctcctgccagagctccagcccctggcaggctccctgcggcgggatgtggttgaagggaacttctacagtgctacgctggccggggaccactgctttgatgtcctagacctccactttcacttccggcatgcagtacagcaccgtcatcgggatggtgtccactgggaccagcatgcacaccgccacctctcacacctgcttctgacccatgtggctgacgcctggggcgtggagctgcccaagcgtggctatccccctgacccgtggattgaggactgggcagagatgaatcatccattccagggaagccataggcagaccccagacttcggggagcacctggccttgctcccacccccaccttcttctttgcctcctcccatgccttttccctacccgcttcctcagccctcgccacctcccctcttcccacccctgccccaggataccccttttttcccaggccagcccttcccaccccatgaattcttcaactataatccagtggaggacttctcgatgccaccccacttaggtaggtgcttctgcagctcccccaccctcttgtacctccccttacccagcctcctatgcctaggtgagctgagaggagttgggtagctccttgtgcccctagcactgggtttggtcacagcagtccctgagtctgaaacatcatctgtaggttcattaatcagctcactggttgtcactgtttcaccgtctgaaggtaggggaaggactatcccttttttgtagatagggaaacagagaagctcacctggaggacaagagttgcttcaaggcagagctgcactcactctggccagaagcctgctcttataatgactggttcttttgtaggatgtggccctggagtgaactttgtgcctggccctctgccacctccaatccctggccctaatccccatggtcagcactggggcccagtggtccaccgggggatgccacgctatgttcctaacagcccctaccatgtgcggagaatgggggggccctgcaggcagcggctcagacactcagagagactgatccacacatacaaactggacagacggcctcctgcccattcggggacatggcctgggtagactggatcttgggctgggactggatgtgccaatggcccttcagggcctgcctggcacctcaggtactgggctagggtgtctgctatgcctggtattgttcttgtccattgctgtcaccaataaaggcatggaagaacagagtgacaaa

SEQ ID NO: 436446 - DNA, 1859 bp, Homo sapiens
gatcccgcccccctcggagcgcccctgtggtctgacttcagcagcactttccggcaggagactgggcactcgctgtcacccgcgagctgcctccctcagcgagatctgagcatctttccggaggctaacagacctgggcttcggggtgaccactgtgcttgcctcagtttccttttctggagcaggggaaggcccggctccctgcccaaaggcggctgtgcgctaagtggcagacgctcggggagagccggcgcggggcggaccccagcgccagtagtgacaggggcgaacgccgccgggagactccagccggcgggcgagcaggcctgtcgttgctggtggcggcatggtcttctgtctgtcgagcgaggagccgcgccgcccgctgcgaagcgacatggtccacttccaggcctcggaagtccagcagctgctacacaacaagttcgtggtcatcttgggggactccattcagagggctgtgtacaaggacctggtgctcttgctccagaaagactcactgctcacagctgcccagctgaaagccaagggggagctgagctttgaacaggaccagctggtggctgggggccagctgggcgagctgcacaacgggacacagtatcgtgaggtccgccagttctgctcgggctctggccaccaccttgtgcgcttctacttcctcactcgtgtttactccgagtaccttgaggatgttctggaagagctgacatatggacctgccccggacctggtgatcatcaactcctgcctctgggatctctccagatatggtcgctgctcaatggagagctaccgggagaacctggagcgggtgtttgtgcgcatggaccaagtattgccagactcctgcctgctggtgtggaacatggcgatgcccctcggggaacgtatcactgggggtttcctcctgccagagctccagcccctggcaggctccctgcggcgggatgtggttgaagggaacttctacagtgctacgctggccggggaccactgctttgatgtcctagacctccactttcacttccggcatgcagtacagcaccgtcatcgggatggtgtccactgggaccagcatgcacaccgccacctctcacacctgcttctgacccatgtggctgacgcctggggcgtggagctgcccaagcgtggctatccccctgacccgtggattgaggactgggcagagatgaatcatccattccagggaagccataggcagaccccagacttcggggagcacctggccttgctcccacccccaccttcttctttgcctcctcccatgccttttccctacccgcttcctcagccctcgccacctcccctcttcccacccctgccccaggataccccttttttcccaggccagcccttcccaccccatgaattcttcaactataatccagtggaggacttctcgatgccaccccacttaggatgtggccctggagtgaactttgtgcctggccctctgccacctccaatccctggccctaatccccatggtcagcactggggcccagtggtccaccgggggatgccacgctatgttcctaacagcccctaccatgtgcggagaatgggggggccctgcaggcagcggctcagacactcagagagactgatccacacatacaaactggacagacggcctcctgcccattcggggacatggcctgggtagactggatcttgggctgggactggatgtgccaatggcccttcagggcctgcctggcacctcaggtactgggctagggtgtctgctatgcctggtattgttcttgtccattgctgtcaccaataaaggcatggaagaacagagtgacaaa

SEQ ID NO: 436447 - DNA, 1777 bp, Homo sapiens
cacgtggcgaggccgccgccgcggccatcaccactgtgggcagcctcacttggctgccgccccgagaccccagcccgtacctgggcttcgcgcccgccaagtgggcccagccctggctcctgcgccctgtggcggccacctccatcgccttgctttcccttcgggcactgggggtcgctcagggcgggacatgggtgaacggaagtggaagctgtgagcgtcgcagcccgaggcgccgaggcctgaggcgccgtcggggccaccgcgacgctcgcatggagagcgctgggcgctgggctgtgcaccgacggctaacctggacccacggtctctgcggggcgggagctttgcagaaccgactggccgactggggcgcgggaacatgaggcttggctaggagcccgctgcgggccaggcgcgcggtgcgcaggcatacccgggtcgcgggtgaacaccgcggagccccgggacttgcctgtcgttgctggtggcggcatggtcttctgtctgtcgagcgaggagccgcgccgcccgctgcgaagcgacatggtccacttccaggcctcggaagtccagcagctgctacacaacaagttcgtggtcatcttgggggactccaagtaccttgaggatgttctggaagagctgacatatggacctgccccggacctggtgatcatcaactcctgcctctgggatctctccagatatggtcgctgctcaatggagagctaccgggagaacctggagcgggtgtttgtgcgcatggaccaagtattgccagactcctgcctgctggtgtggaacatggcgatgcccctcggggaacgtatcactgggggtttcctcctgccagagctccagcccctggcaggctccctgcggcgggatgtggttgaagggaacttctacagtgctacgctggccggggaccactgctttgatgtcctagacctccactttcacttccggcatgcagtacagcaccgtcatcgggatggtgtccactgggaccagcatgcacaccgccacctctcacacctgcttctgacccatgtggctgacgcctggggcgtggagctgcccaagcgtggctatccccctgacccgtggattgaggactgggcagagatgaatcatccattccagggaagccataggcagaccccagacttcggggagcacctggccttgctcccacccccaccttcttctttgcctcctcccatgccttttccctacccgcttcctcagccctcgccacctcccctcttcccacccctgccccaggataccccttttttcccaggccagcccttcccaccccatgaattcttcaactataatccagtggaggacttctcgatgccaccccacttaggatgtggccctggagtgaactttgtgcctggccctctgccacctccaatccctggccctaatccccatggtcagcactggggcccagtggtccaccgggggatgccacgctatgttcctaacagcccctaccatgtgcggagaatgggggggccctgcaggcagcggctcagacactcagagagactgatccacacatacaaactggacagacggcctcctgcccattcggggacatggcctgggtagactggatcttgggctgggactggatgtgccaatggcccttcagggcctgcctggcacctcaggtactgggctagggtgtctgctatgcctggtattgttcttgtccattgctgtcaccaataaaggcatggaagaacagagtgacaaa

SEQ ID NO: 436448 - DNA, 2560 bp, Homo sapiens
ggcagtgtggcagaagcaaagaagcccacagctggggggtgggggtacagtcaactggcagggtgtggaacagggatgttgcatcgggaaggccagccttatggacttgggctcaatggacagtgttccataggcttcttagttcagcctcagagtcccactgtgactggtgcagcttggtgtagctctcctcgggccccatctctgggcctttggtggaggcttctgagggccccactcccccttgttttgaggcactgctccccatcacatctcaactgtaacactctgctgcagaacctctgtttccatgtcaacaccctagtccctgcatgcacacaaagagggcaccatggctgattgtctccatggctgcttctcccctgcatcgtgtccttaaagggcaagtttcctgctgcacttgttgacgactcacccctttcagccccagtgtctagcacaatttccctgtacacagtatcaacagaattgtatttgttgaatgggaggcacgagtcatgttagaaggccgattatggcagcacaagaggatgtgggggcacagagagtccaggaatatcatagagacagacctgtaacacttggtagccaggagttggagcatcagggaggtgaatacagattttggttaaacatccccattttcttgtttagatgtaataattgatccccagcaaatgatgggatgccctgaaggttgtaaggctagttttgatggcttaggcctttgaaatccaatttggagctacagaagttagggccatgaaaagggagagttgatttggggtggaaggatgagttggtgagtttggtcacagcagattgatttgaggttctttggaaatacagagtagatttgcagtcattggtacccagcagagagattaaaactgagggcacagtggcagctgtgagggagacagaacgatgctcatgctttggattggcaggaaagaggggctatggcggaaacaaaaggagatgagggcaggggcacttttaggaaggactgaggctgctggcagtgtcacatgactgttgagaagaagggaatttgttagcaagtggttacatttagtaggaaaagtgttgagggcatgggtttggattaaaggagggagtgagcaattgaggaggaagtggaaattgggcaaaacattccttttggaagtttggatggtaaaaggaagttgttggggaagggaataacaggatctttatgtttggcttatttactggtctatggggaggaggtgggcgaggaaaaagctagatacaagacctgggcaaacaaagaaggctctggagggaagtgtaggttagaacaaaggtaagtctgagaggtaagagagaaggaacacactttgggcttggcctgaaatgagagggaatgaggaaaactgggtagagggcaaggatgctccagcctggtggctctgctctccaagaggaaggaatagagctttagaagtgtggatggccagagttcagggcagcctggctcccaagcctacctaaaacaaccatcccattcctagacccgtggattgaggactgggcagagatgaatcatccattccagggaagccataggcagaccccagacttcggggagcacctggccttgctcccacccccaccttcttctttgcctcctcccatgccttttccctacccgcttcctcagccctcgccacctcccctcttcccacccctgccccaggataccccttttttcccaggccagcccttcccaccccatgaattcttcaactataatccagtggaggacttctcgatgccaccccacttaggtaggtgcttctgcagctcccccaccctcttgtacctccccttacccagcctcctatgcctaggtgagctgagaggagttgggtagctccttgtgcccctagcactgggtttggtcacagcagtccctgagtctgaaacatcatctgtaggttcattaatcagctcactggttgtcactgtttcaccgtctgaaggtaggggaaggactatcccttttttgtagatagggaaacagagaagctcacctggaggacaagagttgcttcaaggcagagctgcactcactctggccagaagcctgctcttataatgactggttcttttgtaggatgtggccctggagtgaactttgtgcctggccctctgccacctccaatccctggccctaatccccatggtcagcactggggcccagtggtccaccgggggatgccacgctatgttcctaacagcccctaccatgtgcggagaatgggggggccctgcaggcagcggctcagacactcagagagactgatccacacatacaaactggacagacggcctcctgcccattcggggacatggcctgggtagactggatcttgggctgggactggatgtgccaatggcccttcagggcctgcctggcacctcaggtactgggctagggtgtctgctatgcctggtattgttcttgtccattgctgtcaccaataaaggcatggaagaacagagtgacaaa

SEQ ID NO: 436449 - DNA, 2231 bp, Homo sapiens
ggcagtgtggcagaagcaaagaagcccacagctggggggtgggggtacagtcaactggcagggtgtggaacagggatgttgcatcgggaaggccagccttatggacttgggctcaatggacagtgttccataggcttcttagttcagcctcagagtcccactgtgactggtgcagcttggtgtagctctcctcgggccccatctctgggcctttggtggaggcttctgagggccccactcccccttgttttgaggcactgctccccatcacatctcaactgtaacactctgctgcagaacctctgtttccatgtcaacaccctagtccctgcatgcacacaaagagggcaccatggctgattgtctccatggctgcttctcccctgcatcgtgtccttaaagggcaagtttcctgctgcacttgttgacgactcacccctttcagccccagtgtctagcacaatttccctgtacacagtatcaacagaattgtatttgttgaatgggaggcacgagtcatgttagaaggccgattatggcagcacaagaggatgtgggggcacagagagtccaggaatatcatagagacagacctgtaacacttggtagccaggagttggagcatcagggaggtgaatacagattttggttaaacatccccattttcttgtttagatgtaataattgatccccagcaaatgatgggatgccctgaaggttgtaaggctagttttgatggcttaggcctttgaaatccaatttggagctacagaagttagggccatgaaaagggagagttgatttggggtggaaggatgagttggtgagtttggtcacagcagattgatttgaggttctttggaaatacagagtagatttgcagtcattggtacccagcagagagattaaaactgagggcacagtggcagctgtgagggagacagaacgatgctcatgctttggattggcaggaaagaggggctatggcggaaacaaaaggagatgagggcaggggcacttttaggaaggactgaggctgctggcagtgtcacatgactgttgagaagaagggaatttgttagcaagtggttacatttagtaggaaaagtgttgagggcatgggtttggattaaaggagggagtgagcaattgaggaggaagtggaaattgggcaaaacattccttttggaagtttggatggtaaaaggaagttgttggggaagggaataacaggatctttatgtttggcttatttactggtctatggggaggaggtgggcgaggaaaaagctagatacaagacctgggcaaacaaagaaggctctggagggaagtgtaggttagaacaaaggtaagtctgagaggtaagagagaaggaacacactttgggcttggcctgaaatgagagggaatgaggaaaactgggtagagggcaaggatgctccagcctggtggctctgctctccaagaggaaggaatagagctttagaagtgtggatggccagagttcagggcagcctggctcccaagcctacctaaaacaaccatcccattcctagacccgtggattgaggactgggcagagatgaatcatccattccagggaagccataggcagaccccagacttcggggagcacctggccttgctcccacccccaccttcttctttgcctcctcccatgccttttccctacccgcttcctcagccctcgccacctcccctcttcccacccctgccccaggataccccttttttcccaggccagcccttcccaccccatgaattcttcaactataatccagtggaggacttctcgatgccaccccacttaggatgtggccctggagtgaactttgtgcctggccctctgccacctccaatccctggccctaatccccatggtcagcactggggcccagtggtccaccgggggatgccacgctatgttcctaacagcccctaccatgtgcggagaatgggggggccctgcaggcagcggctcagacactcagagagactgatccacacatacaaactggacagacggcctcctgcccattcggggacatggcctgggtagactggatcttgggctgggactggatgtgccaatggcccttcagggcctgcctggcacctcaggtactgggctagggtgtctgctatgcctggtattgttcttgtccattgctgtcaccaataaaggcatggaagaacagagtgacaaa

SEQ ID NO: 436450 - DNA, 1442 bp, Homo sapiens
cacgtggcgaggccgccgccgcggccatcaccactgtgggcagcctcacttggctgccgccccgagaccccagcccgtacctgggcttcgcgcccgccaagtgggcccagccctggctcctgcgccctgtggcggccacctccatcgccttgctttcccttcgggcactgggggtcgctcagggcgggacatgggtgaacggaagtggaagctgtgagcgtcgcagcccgaggcgccgaggcctgaggcgccgtcggggccaccgcgacgctcgcatggagagcgctgggcgctgggctgtgcaccgacggctaacctggacccacggtctctgcggggcgggagctttgcagaaccgactggccgactggggcgcgggaacatgaggcttggctaggagcccgctgcgggccaggcgcgcggtgcgcaggcatacccgggtcgcgggtgaacaccgcggagccccgggacttgcctgtcgttgctggtggcggcatggtcttctgtctgtcgagcgaggagccgcgccgcccgctgcgaagcgacatggtccacttccaggcctcggaagtccagcagctgctacacaacaagttcgtggtcatcttgggggactccattcagagggctgtgtacaaggacctggtgctcttgctccagaaagactcactgctcacagctgcccagctgaaagccaagggggagctgagctttgaacaggaccagctggtggctgggggccagctgggcgagctgcacaacgggacacagtatcgtgaggtccgccagttctgctcgggctctggccaccaccttgtgcgcttctacttcctcactcgtgtttactccgagtaccttgaggatgttctggaagagctgacatatggacctgccccggacctggtgatcatcaactcctgcctctgggatctctccagatatggtcgctgctcaatggagagctaccgggagaacctggagcgggtgtttgtgcgcatggaccaagtattgccagactcctgcctgctggtgtggaacatggcgatgcccctcggggaacgtatcactgggggtttcctcctgccagagctccagcccctggcaggctccctgcggcgggatgtggttgaagggaacttctacagtgctacgctggccggggaccactgctttgatgtcctagacctccactttcacttccggcatgcagtacagcaccgtcatcgggatggtgtccactgggaccagcatgcacaccgccacctctcacacctgcttctgacccatgtggctgacgcctggggcgtggagctgcccaagcgtggctatccccctggtgagccctaccataagtgggggggtagtgatgcactggggccctcagaggacagggctcagaaacagaatgggacacagccactcaagggaagtagaggtccctt

SEQ ID NO: 436451 - DNA, 1406 bp, Homo sapiens
cacgtggcgaggccgccgccgcggccatcaccactgtgggcagcctcacttggctgccgccccgagaccccagcccgtacctgggcttcgcgcccgccaagtgggcccagccctggctcctgcgccctgtggcggccacctccatcgccttgctttcccttcgggcactgggggtcgctcagggcgggacatgggtgaacggaagtggaagctgtgagcgtcgcagcccgaggcgccgaggcctgaggcgccgtcggggccaccgcgacgctcgcatggagagcgctgggcgctgggctgtgcaccgacggctaacctggacccacggtctctgcggggcgggagctttgcagaaccgactggccgactggggcgcgggaacatgaggcttggctaggagcccgctgcgggccaggcgcgcggtgcgcaggcatacccgggtcgcgggtgaacaccgcggagccccgggacttgcctgtcgttgctggtggcggcatggtcttctgtctgtcgagcgaggagccgcgccgcccgctgcgaagcgacatggtccacttccaggcctcggaagtccagcagctgctacacaacaagttcgtggtcatcttgggggactccattcagagggctgtgtacaaggacctggtgctcttgctccagaaagactcactgctcacagctgcccagctgaaagccaagagtaccttgaggatgttctggaagagctgacatatggacctgccccggacctggtgatcatcaactcctgcctctgggatctctccagatatggtcgctgctcaatggagagctaccgggagaacctggagcgggtgtttgtgcgcatggaccaagtattgccagactcctgcctgctggtgtggaacatggcgatgcccctcggggaacgtatcactgggggtttcctcctgccagaggccagcccttcccaccccatgaattcttcaactataatccagtggaggacttctcgatgccaccccacttaggatgtggccctggagtgaactttgtgcctggccctctgccacctccaatccctggccctaatccccatggtcagcactggggcccagtggtccaccgggggatgccacgctatgttcctaacagcccctaccatgtgcggagaatgggggggccctgcaggcagcggctcagacactcagagagactgatccacacatacaaactggacagacggcctcctgcccattcggggacatggcctgggtagactggatcttgggctgggactggatgtgccaatggcccttcagggcctgcctggcacctcaggtactgggctagggtgtctgctatgcctggtattgttcttgtccattgctgtcaccaataaaggcatggaagaacagagtgacaaa

SEQ ID NO: 436452 - DNA, 936 bp, Homo sapiens
cacgtggcgaggccgccgccgcggccatcaccactgtgggcagcctcacttggctgccgccccgagaccccagcccgtacctgggcttcgcgcccgccaagtgggcccagccctggctcctgcgccctgtggcggccacctccatcgccttgctttcccttcgggcactgggggtcgctcagggcgggacatgggtgaacggaagtggaagctgtgagcgtcgcagcccgaggcgccgaggcctgaggcgccgtcggggccaccgcgacgctcgcatggagagcgctgggcgctgggctgtgcaccgacggctaacctggacccacggtctctgcggggcgggagctttgcagaaccgactggccgactggggcgcgggaacatgaggcttggctaggagcccgctgcgggccaggcgcgcggtgcgcaggcatacccgggtcgcgggtgaacaccgcggagccccgggacttgcctgtcgttgctggtggcggcatggtcttctgtctgtcgagcgaggagccgcgccgcccgctgcgaagcgacatggtccacttccaggcctcggaagtccagcagctgctacacaacaagttcgtggtcatcttgggggactccagtgagtgcctcttctagggtgacgcttccagtcccacaccttgcacccctaccatgtgcggagaatgggggggccctgcaggcagcggctcagacactcagagagactgatccacacatacaaactggacagacggcctcctgcccattcggggacatggcctgggtagactggatcttgggctgggactggatgtgccaatggcccttcagggcctgcctggcacctcaggtactgggctagggtgtctgctatgcctggtattgttcttgtccattgctgtcaccaataaaggcatggaagaacagagtgacaaa

SEQ ID NO: 436453 - DNA, 1435 bp, Homo sapiens
gatcccgcccccctcggagcgcccctgtggtctgacttcagcagcactttccggcaggagactgggcactcgctgtcacccgcgagctgcctccctcagcgagatctgagcatctttccggaggctaacagacctgggcttcggggtgaccactgtgcttgcctcagtttccttttctggagcaggggaaggcccggctccctgcccaaaggcggctgtgcgctaagtggcagacgctcggggagagccggcgcggggcggaccccagcgccagtagtgacaggggcgaacgccgccgggagactccagccggcgggcgagcaggcctgtcgttgctggtggcggcatggtcttctgtctgtcgagcgaggagccgcgccgcccgctgcgaagcgacatggtccacttccaggcctcggaagtccagcagctgctacacaacaagttcgtggtcatcttgggggactccattcagagggctgtgtacaaggacctggtgctcttgctccagaaagactcactgctcacagctgcccagctgaaagccaagagtaccttgaggatgttctggaagagctgacatatggacctgccccggacctggtgatcatcaactcctgcctctgggatctctccagatatggtcgctgctcaatggagagctaccgggagaacctggagcgggtgtttgtgcgcatggaccaagtattgccagactcctgcctgctggtgtggaacatggcgatgcccctcggggaacgtatcactgggggtttcctcctgccagagctccagcccctggcaggctccctgcggcgggatgtggttgaagggaacttctacagtgctacgctggccggggaccactgctttgatgtcctagacctccactttcacttccggcatgcagtacagcaccgtcatcgggatggtgtccactgggaccagcatgcacaccgccacctctcacacctgcttctgacccatgaattcttcaactataatccagtggaggacttctcgatgccaccccacttaggatgtggccctggagtgaactttgtgcctggccctctgccacctccaatccctggccctaatccccatggtcagcactggggcccagtggtccaccgggggatgccacgctatgttcctaacagcccctaccatgtgcggagaatgggggggccctgcaggcagcggctcagacactcagagagactgatccacacatacaaactggacagacggcctcctgcccattcggggacatggcctgggtagactggatcttgggctgggactggatgtgccaatggcccttcagggcctgcctggcacctcaggtactgggctagggtgtctgctatgcctggtattgttcttgtccattgctgtcaccaataaaggcatggaagaacagagtgacaaa

SEQ ID NO: 436454 - DNA, 307 bp, Homo sapiens
ggcagtgtggcagaagcaaagaagcccacagctggggggtgggggtacagtcaactggcagggtgtggaacagggatgttgcatcgggaaggccagccttatggacttgggctcaatggacagtgttccataggcttcttagttcagcctcagagtcccactgtgactggtgcagcttggtgtagctctcctcgggccccatctctgggcctttggtggaggcttctgagggcccctccaactcttcctcccctatcatcccctgtggaatgttggtctcactctctggggaagtcaggggagaagt

SEQ ID NO: 436455 - DNA, 1857 bp, Homo sapiens
cacgtggcgaggccgccgccgcggccatcaccactgtgggcagcctcacttggctgccgccccgagaccccagcccgtacctgggcttcgcgcccgccaagtgggcccagccctggctcctgcgccctgtggcggccacctccatcgccttgctttcccttcgggcactgggggtcgctcagggcgggacatgggtgaacggaagtggaagctgtgagcgtcgcagcccgaggcgccgaggcctgaggcgccgtcggggccaccgcgacgctcgcatggagagcgctgggcgctgggctgtgcaccgacggctaacctggacccacggtctctgcggggcgggagctttgcagaaccgactggccgactggggcgcgggaacatgaggcttggctaggagcccgctgcgggccaggcgcgcggtgcgcaggcatacccgggtcgcgggtgaacaccgcggagccccgggacttgcctgtcgttgctggtggcggcatggtcttctgtctgtcgagcgaggagccgcgccgcccgctgcgaagcgacatggtccacttccaggcctcggaagtccagcagctgctacacaacaagttcgtggtcatcttgggggactccattcagagggctgtgtacaaggacctggtgctcttgctccagaaagactcactgctcacagctgcccagctgaaagccaagagtaccttgaggatgttctggaagagctgacatatggacctgccccggacctggtgatcatcaactcctgcctctgggatctctccagatatggtcgctgctcaatggagagctaccgggagaacctggagcgggtgtttgtgcgcatggaccaagtattgccagactcctgcctgctggtgtggaacatggcgatgcccctcggggaacgtatcactgggggtttcctcctgccagagctccagcccctggcaggctccctgcggcgggatgtggttgaagggaacttctacagtgctacgctggccggggaccactgctttgatgtcctagacctccactttcacttccggcatgcagtacagcaccgtcatcgggatggtgtccactgggaccagcatgcacaccgccacctctcacacctgcttctgacccatgtggctgacgcctggggcgtggagctgcccaagcgtggctatccccctgacccgtggattgaggactgggcagagatgaatcatccattccagggaagccataggcagaccccagacttcggggagcacctggccttgctcccacccccaccttcttctttgcctcctcccatgccttttccctacccgcttcctcagccctcgccacctcccctcttcccacccctgccccaggataccccttttttcccaggccagcccttcccaccccatgaattcttcaactataatccagtggaggacttctcgatgccaccccacttaggatgtggccctggagtgaactttgtgcctggccctctgccacctccaatccctggccctaatccccatggtcagcactggggcccagtggtccaccgggggatgccacgctatgttcctaacagcccctaccatgtgcggagaatgggggggccctgcaggcagcggctcagacactcagagagactgatccacacatacaaactggacagacggcctcctgcccattcggggacatggcctgggtagactggatcttgggctgggactggatgtgccaatggcccttcagggcctgcctggcacctcaggtactgggctagggtgtctgctatgcctggtattgttcttgtccattgctgtcaccaataaaggcatggaagaacagagtgacaaa

SEQ ID NO: 436456 - DNA, 1398 bp, Homo sapiens
cttacgcgcgtctgctggcccttacgcgcgtctgctggcccttacgcgcgtctgctggcccttacgcgcgtctgctggcccttacgcgcggggagctgagctttgaacaggaccagctggtggctgggggccagctgggcgagctgcacaacgggacacagtatcgtgaggtccgccagttctgctcgggctctggccaccaccttgtgcgcttctacttcctcactcgtgtttactccgagtaccttgaggatgttctggaagagctgacatatggacctgccccggacctggtgatcatcaactcctgcctctgggatctctccagatatggtcgctgctcaatggagagctaccgggagaacctggagcgggtgtttgtgcgcatggaccaagtattgccagactcctgcctgctggtgtggaacatggcgatgcccctcggggaacgtatcactgggggtttcctcctgccagagctccagcccctggcaggctccctgcggcgggatgtggttgaagggaacttctacagtgctacgctggccggggaccactgctttgatgtcctagacctccactttcacttccggcatgcagtacagcaccgtcatcgggatggtgtccactgggaccagcatgcacaccgccacctctcacacctgcttctgacccatgtggctgacgcctggggcgtggagctgcccaagcgtggctatccccctgacccgtggattgaggactgggcagagatgaatcatccattccagggaagccataggcagaccccagacttcggggagcacctggccttgctcccacccccaccttcttctttgcctcctcccatgccttttccctacccgcttcctcagccctcgccacctcccctcttcccacccctgccccaggataccccttttttcccaggccagcccttcccaccccatgaattcttcaactataatccagtggaggacttctcgatgccaccccacttaggatgtggccctggagtgaactttgtgcctggccctctgccacctccaatccctggccctaatccccatggtcagcactggggcccagtggtccaccgggggatgccacgctatgttcctaacagcccctaccatgtgcggagaatgggggggccctgcaggcagcggctcagacactcagagagactgatccacacatacaaactggacagacggcctcctgcccattcggggacatggcctgggtagactggatcttgggctgggactggatgtgccaatggcccttcagggcctgcctggcacctcaggtactgggctagggtgtctgctatgcctggtattgttcttgtccattgctgtcaccaataaaggcatggaagaacagagtgacaaa

SEQ ID NO: 436457 - DNA, 1735 bp, Homo sapiens
cacgtggcgaggccgccgccgcggccatcaccactgtgggcagcctcacttggctgccgccccgagaccccagcccgtacctgggcttcgcgcccgccaagtgggcccagccctggctcctgcgccctgtggcggccacctccatcgccttgctttcccttcgggcactgggggtcgctcagggcgggacatgggtgaacggaagtggaagctgtgagcgtcgcagcccgaggcgccgaggcctgaggcgccgtcggggccaccgcgacgctcgcatggagagcgctgggcgctgggctgtgcaccgacggctaacctggacccacggtctctgcggggcgggagctttgcagaaccgactggccgactggggcgcgggaacatgaggcttggctaggagcccgctgcgggccaggcgcgcggtgcgcaggcatacccgggtcgcgggtgaacaccgcggagccccgggacttgcctgtcgttgctggtggcggcatggtcttctgtctgtcgagcgaggagccgcgccgcccgctgcgaagcgacatggtccacttccaggcctcggaagtccagcagctgctacacaacaagttcgtggtcatcttgggggactccattcagagggctgtgtacaaggacctggtgctcttgctccagaaagactcactgctcacagctgcccagctgaaagccaagggggagctgagctttgaacaggaccagctggtggctgggggccagctgggcgagctgcacaacgggacacagtatcgtgaggtccgccagttctgctcgggctctggccaccaccttgtgcgcttctacttcctcactcgtgtttactccgagtaccttgaggatgttctggaagagctgacatatggacctgccccggacctggtgatcatcaactcctgcctctgggatctctccagatatggtcgctgctcaatggagagctaccgggagaacctggagcgggtgtttgtgcgcatggaccaagtattgccagactcctgcctgctggtgtggaacatggcgatgcccctcggggaacgtatcactgggggtttcctcctgccagagctccagcccctggcaggctccctgcggcgggatgtggttgaagggaacttctacagtgctacgctggccggggaccactgctttgatgtcctagacctccactttcacttccggcatgcagtacagcaccgtcatcgggatggtgtccactgggaccagcatgcacaccgccacctctcacacctgcttctgacccatgaattcttcaactataatccagtggaggacttctcgatgccaccccacttaggatgtggccctggagtgaactttgtgcctggccctctgccacctccaatccctggccctaatccccatggtcagcactggggcccagtggtccaccgggggatgccacgctatgttcctaacagcccctaccatgtgcggagaatgggggggccctgcaggcagcggctcagacactcagagagactgatccacacatacaaactggacagacggcctcctgcccattcggggacatggcctgggtagactggatcttgggctgggactggatgtgccaatggcccttcagggcctgcctggcacctcaggtactgggctagggtgtctgctatgcctggtattgttcttgtccattgctgtcaccaataaaggcatggaagaacagagtgacaaa

SEQ ID NO: 436458 - DNA, 1183 bp, Homo sapiens
gcgccagaggatccttcggggttgtgcatcagttatgctttatgtgcccatcagttcaaagaaactgccccggacctggtgatcatcaactcctgcctctgggatctctccagatatggtcgctgctcaatggagagctaccgggagaacctggagcgggtgtttgtgcgcatggaccaagtattgccagactcctgcctgctggtgtggaacatggcgatgcccctcggggaacgtatcactgggggtttcctcctgccagagctccagcccctggcaggctccctgcggcgggatgtggttgaagggaacttctacagtgctacgctggccggggaccactgctttgatgtcctagacctccactttcacttccggcatgcagtacagcaccgtcatcgggatggtgtccactgggaccagcatgcacaccgccacctctcacacctgcttctgacccatgtggctgacgcctggggcgtggagctgcccaagcgtggctatccccctgacccgtggattgaggactgggcagagatgaatcatccattccagggaagccataggcagaccccagacttcggggagcacctggccttgctcccacccccaccttcttctttgcctcctcccatgccttttccctacccgcttcctcagccctcgccacctcccctcttcccacccctgccccaggataccccttttttcccaggccagcccttcccaccccatgaattcttcaactataatccagtggaggacttctcgatgccaccccacttaggatgtggccctggagtgaactttgtgcctggccctctgccacctccaatccctggccctaatccccatggtcagcactggggcccagtggtccaccgggggatgccacgctatgttcctaacagcccctaccatgtgcggagaatgggggggccctgcaggcagcggctcagacactcagagagactgatccacacatacaaactggacagacggcctcctgcccattcggggacatggcctgggtagactggatcttgggctgggactggatgtgccaatggcccttcagggcctgcctggcacctcaggtactgggctagggtgtctgctatgcctggtattgttcttgtccattgctgtcaccaataaaggcatggaagaacagagtgacaaa

SEQ ID NO: 436459 - DNA, 1010 bp, Homo sapiens
agagatgggatagcagactggtagataggacaccctgctttcagaccctgctgcgttctgtggctcttagaggctgcactttctcacttagctccagcccctggcaggctccctgcggcgggatgtggttgaagggaacttctacagtgctacgctggccggggaccactgctttgatgtcctagacctccactttcacttccggcatgcagtacagcaccgtcatcgggatggtgtccactgggaccagcatgcacaccgccacctctcacacctgcttctgacccatgtggctgacgcctggggcgtggagctgcccaagcgtggctatccccctgacccgtggattgaggactgggcagagatgaatcatccattccagggaagccataggcagaccccagacttcggggagcacctggccttgctcccacccccaccttcttctttgcctcctcccatgccttttccctacccgcttcctcagccctcgccacctcccctcttcccacccctgccccaggataccccttttttcccaggccagcccttcccaccccatgaattcttcaactataatccagtggaggacttctcgatgccaccccacttaggatgtggccctggagtgaactttgtgcctggccctctgccacctccaatccctggccctaatccccatggtcagcactggggcccagtggtccaccgggggatgccacgctatgttcctaacagcccctaccatgtgcggagaatgggggggccctgcaggcagcggctcagacactcagagagactgatccacacatacaaactggacagacggcctcctgcccattcggggacatggcctgggtagactggatcttgggctgggactggatgtgccaatggcccttcagggcctgcctggcacctcaggtactgggctagggtgtctgctatgcctggtattgttcttgtccattgctgtcaccaataaaggcatggaagaacagagtgacaaa

SEQ ID NO: 436460 - DNA, 1342 bp, Homo sapiens
ggcagtgtggcagaagcaaagaagcccacagctggggggtgggggtacagtcaactggcagggtgtggaacagggatgttgcatcgggaaggccagccttatggacttgggctcaatggacagtgttccataggcttcttagttcagcctcagagtcccactgtgactggtgcagcttggtgtagctctcctcgggccccatctctgggcctttggtggaggcttctgagggccccactcccccttgttttgaggcactgctccccatcacatctcaactgtaacactctgctgcagaacctctgtttccatgtcaacaccctagtccctgcatgcacacaaagagggcaccatggctgattgtctccatggctgcttctcccctgcatcgtgtccttaaagggcaagtttcctgctgcacttgttgacgactcacccctttcagccccagtgtctagcacaatttccctgtacacagtatcaacagaattgtatttgttgaatgggaggcacgagtcatgttagaaggccgattatggcagcacaagaggatgtgggggcacagagagtccaggaatatcatagagacagacctgtaacacttggtagccaggagttggagcatcagggaggtgaatacagattttggttaaacatccccattttcttgtttagatgtaataattgatccccagcaaatgatgggatgccctgaaggttgtaaggctagttttgatggcttaggcctttgaaatccaatttggagctacagaagttagggccatgaaaagggagagttgatttggggtggaaggatgagttggtgagtttggtcacagcagattgatttgaggttctttggaaatacagagtagatttgcagtcattggtacccagcagagagattaaaactgagggcacagtggcagctgtgagggagacagaacgatgctcatgctttggattggcaggaaagaggggctatggcggaaacaaaaggagatgagggcaggggcacttttaggaaggactgaggctgctggcagtgtcacatgactgttgagaagaagggaatttgttagcaagtggttacatttagtaggaaaagtgttgagggcatgggtttggattaaaggagggagtgagcaattgaggaggaagtggaaattgggcaaaacattccttttggaagtttggatggtaaaaggaagttgttggggaagggaataacaggatctttatgtttggcttatttactggtctatggggaggaggtgggcgaggaaaaagctagatacaagacctgggcactcattatgaggggtccgagctcgatcgtcga

SEQ ID NO: 436461 - DNA, 633 bp, Homo sapiens
gggaatgaattggaagtaagcattatgatggtggtagaagcactatgtgaacttcattgtcctgaagctatacagggaattgctgtctggtcatcatctattgttggaaaacatcttctgtggattaactcagtggctcaacaggctgaagggaggtttgaaaaggcctctgtggagtaccaggaacacctgtgtgccatgacaggtgttgattgctgcatctccagctttgacaaatcggtgctcaccttagccagtgctgggtgtaagagtgccagcctgaaacattgtctgaatggtgaatccagaaaaagtgtgctgtccaaaccgactgactcttcccctgaggttataaattatttaggaaacaaagcatgtgagtgctacatctcaactgccgattgggctgctgtgcaggaatggcagaacgctatccatgacttgaaaaagagtaccagtagcacttccctcaacctgaaagctgacttcaactatataaaatcattaagcagctttgaatcttggaaaattggccaaagaccgggcaaatttgaatggtcccccgaaaaattttaattctttgctgggggctcaggaaaatttcccctaaaaaaagcttcttaaacctgagaa

SEQ ID NO: 436462 - DNA, 367 bp, Homo sapiens
tactactaaattcgcggccgcgtcgacttttttttgtaagagaaaattaaaggtggttttttttttttaaattttgctttattgaggtttatattacacattctaagtgtatggtttgatgagttctaacatgtcttcacttgtgtgaccaccaatacgatcgagatagagaacagcgtcttaccccagaaggttcccttgggatcatctcctcatttgcccctgtcagcagttactgatttgctttctgtcactatggattagacttgtctttactaaagtttcatgtacgtgaaatcataacaacatgttctcttgtgtttggcttctcttgctcagcaagagaagcgtcgacgcggccgcgaat

SEQ ID NO: 436463 - DNA, 489 bp, Homo sapiens
cctcagggcgccctgaaaggaccaggacatgcgggtgcggtggatgctcttttggctcctctttgggctcctactggaatttatcagccatcagtgcatctctgtgagtagacgctggacccgtggggtttcttcctttttactgggctgtatcacgtggcatgaaattacacagctcaggcctgtaatcccagcactttggggggccgaggtgggcagatcacttgagtccaggagttgaagactagccagggcatcatggcgaaaccccatctctacaaaaaattccaataaagattagtcgggcctggtggtgcgtacctgttatcccagttactggagaggctgaggtgggaggatcgcttgggcccaggagctggacgttgcagtgagccgagatggccccgctgcactcttgtttttaacaaagaaaataaaaattagccaggcacagtggcacgtgcctctggtcccagaggattgcctgag

SEQ ID NO: 436464 - DNA, 631 bp, Homo sapiens
gtgggcggatcacaaggtcaggagttccagaccagcctggccaatatggtgaaaccctgtctctaataaaatacaaaaattagccgggtgtggtggtgggcgcctgtagtcccacctacttgggaggctgaggcaggagaatagtttgaacccgggaggcagagtctgcagtgagccgagattgcaccactgcactccagcctaggcgacagagcgagactctgtctcaaaaacagcaacaactacaaacaaacaaaaaacagggttaacaaaagtatggaattcaattctttttatatgctgcagccatgttcctgccctagatttggctgggcatggtggctcacgcctgtaatcccagcactttgggaggctgaggcaggcggatcacgaggttaggagttggagaccagcctgaccaacatggtgaaaccccatctctactaaaaatacaaaaattagccaggcatggtggcacacgcctgtaatcccagctactcaggaggctgaggcaggacaatcccttggacccgggaggcggaggttgcagtgagccgagattgtaccattgcactccagcctgggtgacagaatggaatgagactctgtctcaaaaaaaaaaaaaaaaaaa

SEQ ID NO: 436465 - DNA, 301 bp, Homo sapiens
cctcagggcgccctgaaaggaccaggacatgcgggtgcggtggatgctcttttggctcctctttgggctcctactggaatttatcagccatcagtgcatctctgttatcaatactctggctgaccatcatcatcgtgggactgactttggtggaagtccttggttacatgtcattattgcatttccgacaagttataaagttgtcattaccctctggatagtttacctttgggtgagtatactaactttctgtagaggtatacttgtaatcacaaataagaataaattatataaaacaatt

SEQ ID NO: 436466 - DNA, 2581 bp, Homo sapiens
acaaggtctggctctgttgcccaggttggagtgtaggagggcgatctcagctcactgtaacatcaacctcccaggctcaagcaatcctctcacttcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccactggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttatttaagacagagtttcgctcttgttgcccaggctggagtgcagtggcacgatctcagctcaccacagcctccgcctcccaggttcaagcgattctcctgcctcagcctcccgagtagctgggattacaggcatgagccaccgtgcctggccagaaaattgtaaacacacacaaactctcaagtggcctaattccctctcaccaaaccaatcacaatacagataaaagagaataacttgtgttcatttttgtacaaacaaaaaagatataaattgtgaatgatgcatgatttttaattacaagtaaactgggcaaatgcttctgcattatttaaagctaaaaggtgatcagtggaaactttcctctgttagtactctaatactttttatatttatcggctcactacaacctgtgcctaccaggttcaagcgattctcctgtctcagccacctgagtagccgagaccacaggcacgcactaccatgtccggctaattttgtatttttaatagagacagggtttcaccgtgttggccatgctggtcttgaactcctgacctcaaccgatccgcctgccttggcctcccaaagttctgggattacaagcgtgagccacagcgcccagccttattataattgttactatttaaatctcttttgctctctccttcaagagagacctcatcccattcagttgcttccatttatttattcatcttctgcctcctgggctcgagagatcctccagcgtgagtctcccaagtagctgggactacaggctcacaccaccaagcttggctaaattttgtaggttttggagagacaggctcttgccacgttgcctaggctggtctcaaactcctgggctcagatgatccacctgccttcgcctcccaaagcactgggacatgagccaccacgcccagccgcaagtacttttacacaaaatgcaaacaccattcttccatcataaaagtgataccacagcttccgtgaagttttgccaggtagtactcataattaccttgggtaaactttttgatgttaaactgtatcttcttattacgagtttt

SEQ ID NO: 436467 - DNA, 2815 bp, Homo sapiens
acaaggtctggctctgttgcccaggttggagtgtaggagggcgatctcagctcactgtaacatcaacctcccaggctcaagcaatcctctcacttcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccactggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttatttaagacagagtttcgctcttgttgcccaggctggagtgcagtggcacgatctcagctcaccacagcctccgcctcccaggttcaagcgattctcctgcctcagcctcccgagtagctgggattacaggtatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatga

SEQ ID NO: 436468 - DNA, 3024 bp, Homo sapiens
acaaggtctggctctgttgcccaggttggagtgtaggagggcgatctcagctcactgtaacatcaacctcccaggctcaagcaatcctctcacttcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccactggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttatttaagacagagtttcgctcttgttgcccaggctggagtgcagtggcacgatctcagctcaccacagcctccgcctcccaggttcaagcgattctcctgcctcagcctcccgagtagctgggattacaggtatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagatctttaaagttgatgacaagagttccagtcctgaatcatggcaaagtgcagtagtgaactgcggggttattctggaaggatctctctatggctgatggtctcagttccggcatcaacctctgactgagaatcaggtctcacacaggaggagtcagatgaggagcaatcctctgcttccgatggagttagttgtgatgaattggtgaggaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatga

SEQ ID NO: 436469 - DNA, 3001 bp, Homo sapiens
acaaggtctggctctgttgcccaggttggagtgtaggagggcgatctcagctcactgtaacatcaacctcccaggctcaagcaatcctctcacttcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccactggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttatttaagacagagtttcgctcttgttgcccaggctggagtgcagtggcacgatctcagctcaccacagcctccgcctcccaggttcaagcgattctcctgcctcagcctcccgagtagctgggattacaggtatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagatctttaaagttgatgacaagagttccagtcctgaatcatggcaaagtgcagtagtgaactgcggggttattctggaaggatctctctatggctgatggtctcagttccggcatcaacctctgactgagaatcaggtctcacacaggaggagtcagatgaggagcaatcctctgcttccgatggagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatga

SEQ ID NO: 436470 - DNA, 4000 bp, Homo sapiens
gggaatgaattggaagtaagcattatgatggtggtagaagcactatgtgaacttcattgtcctgaagctatacagggaattgctgtctggtcatcatctattgttggaaaacatcttctgtggattaactcagtggctcaacaggctgaagggaggtttgaaaaggcctctgtggagtaccaggaacacctgtgtgccatgacaggtgttgattgctgcatctccagctttgacaaatcggtgctcaccttagccagtgctgggtgtaagagtgccagcctgaaacattgtctgaatggtgaatccagaaaaagtgtgctgtccaaaccgactgactcttcccctgaggttataaattatttaggaaacaaagcatgtgagtgctacatctcaactgccgattgggctgctgtgcaggaatggcagaacgctatccatgacttgaaaaagagtaccagtagcacttccctcaacctgaaagctgacttcaactatataaaatcattaagcagctttgagtctggaaaatttgtcgaatgtaccgagcaattagaattgttaccaggagaaaatatcaatctacttgctggaggatcaaaagaaaaaatagacatgaaaaaactgcttcgtaacatgtgaagtccagatccaagggaacctcagaaatccattgaagttccattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcgtctgctttggagaccacagtttctaacagactttcaacagaggactgtcttattccactcttcggcgaagctttacgttcatgtaaacagcatgacgtgaggccgtggatgcaggcattaaggtatactgtgtaccagaatcagttgttggagaaaattaaagttaagtggttttccttttttttttttgtaagagaaaattaaaggtggttttttttttttaaattttgctttattgaggtttatattacacattctaagtgtatggtttgatgagttctaacatgtcttcacttgtgtgaccaccaatacgatcgagatagagaacagcgtcttaccccagaaggttcccttgggatcatctcctcatttgcccctgtcagcagttactgatttgctttctgtcactatggattagacttgtctttactaaagtttcatgtacgtgaaatcataacaacatgttctcttgtgtttggcttctcttgctcagcatgatatttttacggttcacccatattgcatgtatcaggaatataatcctttttattattgagtagtgttctattgtatgtatataccacagtttatttctcccttcatcctttgctagattttggggttttttcacattgcgctattcagtataaacctgctctcaacattcatgtgcaagtctttgagtggacatatatttgcgtttctcttgagtgaatgcaccttgttgggtcacgtggcttaacttaaaaaaattttaatcactgtggtgcatatgtagtgattattagtgattatctcataattttattttcttgtttaatgatgttgagtgtatttcatttgtattttagtttgcaaatgtttgttcaaattcttcacctgtttttaatgaagacgtacgacttatttttgtgttctgaacataagttctttgtcacataaaatgtgctatgaatgttgagttttaaatactccaaatgaatggctagagaattactatttgtagaaatatttatatgtcaaagggatgctaacaatttactttattgctctaaaatagaaaagttgccagaatgctgtggagttttagtggaaaacatgatagctggtgttactgagtaaatttgagtgttaaatgtcaatgtaagctaacggccaagatagggaccactgcagggtggttacttgcagctatgactcaactggtccttcactgccaaacatacctggggttggatcattggcctgacgtttgcaaattgaggaaccttagggcaaatcaatgaacttctgaactgccttcgtcttcagttatatggggatttccccacttttgaggtacttgtaaggattatatgagatgaagagatgagacaaggtatataaaagtcctagcacagagcgtgtcatataatatggcttcacaagtaccctcatctcctttccagtcgttttttgtttttgtttttgtttttttgagaccatctcactctgttgcccaggctggagtgcctcttcatttttatttctttattcagcaagtattgatcaaatgtgctttgtaccaggtactgagctcttcgttgggatataatggtgatcaaggagattgtagattctggcagggaaaactgacatcaaacacggcgacccgacatagtgagaccctgtctctactagaagaactttaaaaatcacctaggtgtgggccgggcacggtggctaacgcctgtaatcccagcactttgagatgctgaggcaggtggatcacgaggtcaggagatcgagaccatcctggataacacggagaaaccccgtctctactaaaaatacaaaaaaattagccgggcgtgggggcgggcatctgtagtcccaattactcgggaggctgcagcaggagaatggcatgaacccgggaggcggatcttgcattgagccaagatcacgccactgcactccagcctgggcgacagaatgagactccatctcaaaaaaaaagaagaaaccaaggatatagaataaaacaagagtgtagatttgggcattgaggccttcaaattggattgttctcaatgtccagaagaaaaaaaaaatttagaagagacccaaatcagaaaacaaaagttgggctgaattcaatgcgaattattttctagctcaatattaatactgcttatgtcagctgaatttcagcctttcaataacagctagtcaagtatttttttagttggttcctattgatcgtcatcttattttagtggaatccattatattgaagatgtcaagttcctcatttcccatacaaagaatgtgagattcatctttcttgaatctttgctaagtgttgaaggggacttttggcatcttttcaggaggactataattgggccctctaactaaaaagtctcctatgccccttagatagatgagatttttttttttgaccttgtacccaccaacattggtgggaggctcagaagggactgtgtttgtaactttgtagcactttctaaacagtgacctgttgtatgggcattataggacagtccgtggggtggggcgggggatgggggagatggacaaatgaggtctggtttaaagaatgagaagtgtgaccaggcatggtgactcatgcctgtaatccagcactttgggatgctgaggcaggaggatcacttgagcccaggagtttgaggttacagtaagctatgattgtgccactgggctccagcctgggtgacagaactagaccctgtctctaaaaaaagaagaagaggtgtgtatccttctaaatgataaaacagatcactcccctgcttacataaaactttccggtggctggccaggcacggtgtgtcacgcctgtaatcccagcactttgggaggccgtggtgggcagatcacgaggtcaggaaatcgagaccatcctggctaacgtggtgaaatcttgtctctactaaaaacacaaaaaattaacccaggtatggtggcatgcacctgtagtcccagctactcgggaggctgaggcaggagaatcgcttgaaccagggaggtggaggttgcagtgagctgagattgcgccactgcactccagcctgggtgacagagactctgtctcaaaaaa

SEQ ID NO: 436471 - DNA, 3718 bp, Homo sapiens
gtagttgggcaagctggtaaatccagaaatctaacatgctgttttcaggcagtctttcatttgggaagtacatggggcagatggaagaacctgagataatcgcaaggatggcaaattgctcagttttttcttctatttttggggtgggaggtggtgtatgtaaagacagttcctttaggcagatcacgtaaattttagatttgctgcaaacaaagatctctcctcttcatcctaaatggggtaaagttcgaccagagatgggggcttctgaatgaatggtgatcttcgagaacttcataataaagcattagttgtaatgtttttctgcagtctgctttatagtaaatgtgctgtgacttttttttttgtaatgtgctttattaagtatattgataaattagacttaatattctgaagaagatttcccttcaaaacaaaaggctttctcttactgtgtgcttgcctcttgtgagtagaagataaatgatgtaagggtatagtgtaatagataaaactactgcaatcaatctgaagtagccaaactatattgcagtcttggacttaagacttgctatatatctgcaaacatatcaacagcctgttttacgttgagtaattttggtttttctctggcaggactgtcttattccactcttcggcgaagctttacgttcatgtaaacagcatgacgtgaggccgtggatgcaggcattaaggtatactgtgtaccagaatcagttgttggagaaaattaaagttaagtggttttccttttttttttttgtaagagaaaattaaaggtggttttttttttttaaattttgctttattgaggtttatattacacattctaagtgtatggtttgatgagttctaacatgtcttcacttgtgtgaccaccaatacgatcgagatagagaacagcgtcttaccccagaaggttcccttgggatcatctcctcatttgcccctgtcagcagttactgatttgctttctgtcactatggattagacttgtctttactaaagtttcatgtacgtgaaatcataacaacatgttctcttgtgtttggcttctcttgctcagcatgatatttttacggttcacccatattgcatgtatcaggaatataatcctttttattattgagtagtgttctattgtatgtatataccacagtttatttctcccttcatcctttgctagattttggggttttttcacattgcgctattcagtataaacctgctctcaacattcatgtgcaagtctttgagtggacatatatttgcgtttctcttgagtgaatgcaccttgttgggtcacgtggcttaacttaaaaaaattttaatcactgtggtgcatatgtagtgattattagtgattatctcataattttattttcttgtttaatgatgttgagtgtatttcatttgtattttagtttgcaaatgtttgttcaaattcttcacctgtttttaatgaagacgtacgacttatttttgtgttctgaacataagttctttgtcacataaaatgtgctatgaatgttgagttttaaatactccaaatgaatggctagagaattactatttgtagaaatatttatatgtcaaagggatgctaacaatttactttattgctctaaaatagaaaagttgccagaatgctgtggagttttagtggaaaacatgatagctggtgttactgagtaaatttgagtgttaaatgtcaatgtaagctaacggccaagatagggaccactgcagggtggttacttgcagctatgactcaactggtccttcactgccaaacatacctggggttggatcattggcctgacgtttgcaaattgaggaaccttagggcaaatcaatgaacttctgaactgccttcgtcttcagttatatggggatttccccacttttgaggtacttgtaaggattatatgagatgaagagatgagacaaggtatataaaagtcctagcacagagcgtgtcatataatatggcttcacaagtaccctcatctcctttccagtcgttttttgtttttgtttttgtttttttgagaccatctcactctgttgcccaggctggagtgcctcttcatttttatttctttattcagcaagtattgatcaaatgtgctttgtaccaggtactgagctcttcgttgggatataatggtgatcaaggagattgtagattctggcagggaaaactgacatcaaacacggcgacccgacatagtgagaccctgtctctactagaagaactttaaaaatcacctaggtgtgggccgggcacggtggctaacgcctgtaatcccagcactttgagatgctgaggcaggtggatcacgaggtcaggagatcgagaccatcctggataacacggagaaaccccgtctctactaaaaatacaaaaaaattagccgggcgtgggggcgggcatctgtagtcccaattactcgggaggctgcagcaggagaatggcatgaacccgggaggcggatcttgcattgagccaagatcacgccactgcactccagcctgggcgacagaatgagactccatctcaaaaaaaaagaagaaaccaaggatatagaataaaacaagagtgtagatttgggcattgaggccttcaaattggattgttctcaatgtccagaagaaaaaaaaaatttagaagagacccaaatcagaaaacaaaagttgggctgaattcaatgcgaattattttctagctcaatattaatactgcttatgtcagctgaatttcagcctttcaataacagctagtcaagtatttttttagttggttcctattgatcgtcatcttattttagtggaatccattatattgaagatgtcaagttcctcatttcccatacaaagaatgtgagattcatctttcttgaatctttgctaagtgttgaaggggacttttggcatcttttcaggaggactataattgggccctctaactaaaaagtctcctatgccccttagatagatgagatttttttttttgaccttgtacccaccaacattggtgggaggctcagaagggactgtgtttgtaactttgtagcactttctaaacagtgacctgttgtatgggcattataggacagtccgtggggtggggcgggggatgggggagatggacaaatgaggtctggtttaaagaatgagaagtgtgaccaggcatggtgactcatgcctgtaatccagcactttgggatgctgaggcaggaggatcacttgagcccaggagtttgaggttacagtaagctatgattgtgccactgggctccagcctgggtgacagaactagaccctgtctctaaaaaaagaagaagaggtgtgtatccttctaaatgataaaacagatcactcccctgcttacataaaactttccggtggctggccaggcacggtgtgtcacgcctgtaatcccagcactttgggaggccgtggtgggcagatcacgaggtcaggaaatcgagaccatcctggctaacgtggtgaaatcttgtctctactaaaaacacaaaaaattaacccaggtatggtggcatgcacctgtagtcccagctactcgggaggctgaggcaggagaatcgcttgaaccagggaggtggaggttgcagtgagctgagattgcgccactgcactccagcctgggtgacagagactctgtctcaaaaaa

SEQ ID NO: 436472 - DNA, 3430 bp, Homo sapiens
ttttgagcctttgaaggcaactgctttttaggggtctgagacatgaaaaaactgcttcgtaacatgtgaagtccagatccaagggaacctcagaaatccattgaagttccattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcgtctgctttggagaccacagtttctaacagactttcaacagaggactgtcttattccactcttcggcgaagctttacgttcatgtaaacagcatgacgtgaggccgtggatgcaggcattaaggtatactgtgtaccagaatcagttgttggagaaaattaaagttaagtggttttccttttttttttttgtaagagaaaattaaaggtggttttttttttttaaattttgctttattgaggtttatattacacattctaagtgtatggtttgatgagttctaacatgtcttcacttgtgtgaccaccaatacgatcgagatagagaacagcgtcttaccccagaaggttcccttgggatcatctcctcatttgcccctgtcagcagttactgatttgctttctgtcactatggattagacttgtctttactaaagtttcatgtacgtgaaatcataacaacatgttctcttgtgtttggcttctcttgctcagcatgatatttttacggttcacccatattgcatgtatcaggaatataatcctttttattattgagtagtgttctattgtatgtatataccacagtttatttctcccttcatcctttgctagattttggggttttttcacattgcgctattcagtataaacctgctctcaacattcatgtgcaagtctttgagtggacatatatttgcgtttctcttgagtgaatgcaccttgttgggtcacgtggcttaacttaaaaaaattttaatcactgtggtgcatatgtagtgattattagtgattatctcataattttattttcttgtttaatgatgttgagtgtatttcatttgtattttagtttgcaaatgtttgttcaaattcttcacctgtttttaatgaagacgtacgacttatttttgtgttctgaacataagttctttgtcacataaaatgtgctatgaatgttgagttttaaatactccaaatgaatggctagagaattactatttgtagaaatatttatatgtcaaagggatgctaacaatttactttattgctctaaaatagaaaagttgccagaatgctgtggagttttagtggaaaacatgatagctggtgttactgagtaaatttgagtgttaaatgtcaatgtaagctaacggccaagatagggaccactgcagggtggttacttgcagctatgactcaactggtccttcactgccaaacatacctggggttggatcattggcctgacgtttgcaaattgaggaaccttagggcaaatcaatgaacttctgaactgccttcgtcttcagttatatggggatttccccacttttgaggtacttgtaaggattatatgagatgaagagatgagacaaggtatataaaagtcctagcacagagcgtgtcatataatatggcttcacaagtaccctcatctcctttccagtcgttttttgtttttgtttttgtttttttgagaccatctcactctgttgcccaggctggagtgcctcttcatttttatttctttattcagcaagtattgatcaaatgtgctttgtaccaggtactgagctcttcgttgggatataatggtgatcaaggagattgtagattctggcagggaaaactgacatcaaacacggcgacccgacatagtgagaccctgtctctactagaagaactttaaaaatcacctaggtgtgggccgggcacggtggctaacgcctgtaatcccagcactttgagatgctgaggcaggtggatcacgaggtcaggagatcgagaccatcctggataacacggagaaaccccgtctctactaaaaatacaaaaaaattagccgggcgtgggggcgggcatctgtagtcccaattactcgggaggctgcagcaggagaatggcatgaacccgggaggcggatcttgcattgagccaagatcacgccactgcactccagcctgggcgacagaatgagactccatctcaaaaaaaaagaagaaaccaaggatatagaataaaacaagagtgtagatttgggcattgaggccttcaaattggattgttctcaatgtccagaagaaaaaaaaaatttagaagagacccaaatcagaaaacaaaagttgggctgaattcaatgcgaattattttctagctcaatattaatactgcttatgtcagctgaatttcagcctttcaataacagctagtcaagtatttttttagttggttcctattgatcgtcatcttattttagtggaatccattatattgaagatgtcaagttcctcatttcccatacaaagaatgtgagattcatctttcttgaatctttgctaagtgttgaaggggacttttggcatcttttcaggaggactataattgggccctctaactaaaaagtctcctatgccccttagatagatgagatttttttttttgaccttgtacccaccaacattggtgggaggctcagaagggactgtgtttgtaactttgtagcactttctaaacagtgacctgttgtatgggcattataggacagtccgtggggtggggcgggggatgggggagatggacaaatgaggtctggtttaaagaatgagaagtgtgaccaggcatggtgactcatgcctgtaatccagcactttgggatgctgaggcaggaggatcacttgagcccaggagtttgaggttacagtaagctatgattgtgccactgggctccagcctgggtgacagaactagaccctgtctctaaaaaaagaagaagaggtgtgtatccttctaaatgataaaacagatcactcccctgcttacataaaactttccggtggctggccaggcacggtgtgtcacgcctgtaatcccagcactttgggaggccgtggtgggcagatcacgaggtcaggaaatcgagaccatcctggctaacgtggtgaaatcttgtctctactaaaaacacaaaaaattaacccaggtatggtggcatgcacctgtagtcccagctactcgggaggctgaggcaggagaatcgcttgaaccagggaggtggaggttgcagtgagctgagattgcgccactgcactccagcctgggtgacagagactctgtctcaaaaaa

SEQ ID NO: 436473 - DNA, 3265 bp, Homo sapiens
gggaatgaattggaagtaagcattatgatggtggtagaagcactatgtgaacttcattgtcctgaagctatacagggaattgctgtctggtcatcatctattgttggaaaacatcttctgtggattaactcagtggctcaacaggctgaagggaggtttgaaaaggcctctgtggagtaccaggaacacctgtgtgccatgacaggtgttgattgctgcatctccagctttgacaaatcggtgctcaccttagccagtgctgggtgtaagagtgccagcctgaaacattgtctgaatggtgaatccagaaaaagtgtgctgtccaaaccgactgactcttcccctgaggttataaattatttaggaaacaaagcatgtgagtgctacatctcaactgccgattgggctgctgtgcaggaatggcagaacgctatccatgacttgaaaaagagtaccagtagcacttccctcaacctgaaagctgacttcaactatataaaatcattaagcagctttgagtctggaaaatttgtcgaatgtaccgagcaattagaattgttaccaggagaaaatatcaatctacttgctggaggatcaaaagaaaaaatagacatgaaaaaactgcttcgtaacatgtgaagtccagatccaagggaacctcagaaatccattgaagttccattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcgtctgctttggagaccacagtttctaacagactttcaacagaggactgtcttattccactcttcggcgaagctttacgttcatgtaaacagcatgacgtgaggccgtggatgcaggcattaaggtatactgtgtaccagaatcagttgttggagaaaattaaagttaagtggttttccttttttttttttgtaagagaaaattaaaggtggttttttttttttaaattttgctttattgaggtttatattacacattctaagtgtatggtttgatgagttctaacatgtcttcacttgtgtgaccaccaatacgatcgagatagagaacagcgtcttaccccagaaggttcccttgggatcatctcctcatttgcccctgtcagcagttactgatttgctttctgtcactatggattagacttgtctttactaaagtttcatgtacgtgaaatcataacaacatgttctcttgtgtttggcttctcttgctcagcatgatatttttacggttcacccatattgcatgtatcaggaatataatcctttttattattgagtagtgttctattgtatgtatataccacagtttatttctcccttcatcctttgctagattttggggttttttcacattgcgctattcagtataaacctgctctcaacattcatgtgcaagtctttgagtggacatatatttgcgtttctcttgagtgaatgcaccttgttgggtcacgtggcttaacttaaaaaaattttaatcactgtggtgcatatgtagtgattattagtgattatctcataattttattttcttgtttaatgatgttgagtgtatttcatttgtattttagtttgcaaatgtttgttcaaattcttcacctgtttttaatgaagacgtacgacttatttttgtgttctgaacataagttctttgtcacataaaatgtgctatgaatgttgagttttaaatactccaaatgaatggctagagaattactatttgtagaaatatttatatgtcaaagggatgctaacaatttactttattgctctaaaatagaaaagttgccagaatgctgtggagttttagtggaaaacatgatagctggtgttactgagtaaatttgagtgttaaatgtcaatgtaagctaacggccaagatagggaccactgcagggtggttacttgcagctatgactcaactggtccttcactgccaaacataccctgggcgacagaatgagactccatctcaaaaaaaaagaagaaaccaaggatatagaataaaacaagagtgtagatttgggcattgaggccttcaaattggattgttctcaatgtccagaagaaaaaaaaaatttagaagagacccaaatcagaaaacaaaagttgggctgaattcaatgcgaattattttctagctcaatattaatactgcttatgtcagctgaatttcagcctttcaataacagctagtcaagtatttttttagttggttcctattgatcgtcatcttattttagtggaatccattatattgaagatgtcaagttcctcatttcccatacaaagaatgtgagattcatctttcttgaatctttgctaagtgttgaaggggacttttggcatcttttcaggaggactataattgggccctctaactaaaaagtctcctatgccccttagatagatgagatttttttttttgaccttgtacccaccaacattggtgggaggctcagaagggactgtgtttgtaactttgtagcactttctaaacagtgacctgttgtatgggcattataggacagtccgtggggtggggcgggggatgggggagatggacaaatgaggtctggtttaaagaatgagaagtgtgaccaggcatggtgactcatgcctgtaatccagcactttgggatgctgaggcaggaggatcacttgagcccaggagtttgaggttacagtaagctatgattgtgccactgggctccagcctgggtgacagaactagaccctgtctctaaaaaaagaagaagaggtgtgtatccttctaaatgataaaacagatcactcccctgcttacataaaactttccggtggctggccaggcacggtgtgtcacgcctgtaatcccagcactttgggaggccgtggtgggcagatcacgaggtcaggaaatcgagaccatcctggctaacgtggtgaaatcttgtctctactaaaaacacaaaaaattaacccaggtatggtggcatgcacctgtagtcccagctactcgggaggctgaggcaggagaatcgcttgaaccagggaggtggaggttgcagtgagctgagattgcgccactgcactccagcctgggtgacagagactctgtctcaaaaaa

SEQ ID NO: 436474 - DNA, 2784 bp, Homo sapiens
  misc_feature (80)..(80): n is a, c, g, or t
agagtccccttcttaatatagaaagaaatcccgggcctgcagtagagtgataggactttctatgcttccagcaaatatanccatgatggaaatcaaatagtaaaggctgttctgcctttttatcttcttagctcatcttaaataagtagtacacttggatgcagtgcgtctgaagtgctaatcagttgtaacaataggacaactactacccggttgtagttgttctattgtatgtatataccacagtttatttctcccttcatcctttgctagattttggggttttttcacattgcgctattcagtataaacctgctctcaacattcatgtgcaagtctttgagtggacatatatttgcgtttctcttgagtgaatgcaccttgttgggtcacgtggcttaacttaaaaaaattttaatcactgtggtgcatatgtagtgattattagtgattatctcataattttattttcttgtttaatgatgttgagtgtatttcatttgtattttagtttgcaaatgtttgttcaaattcttcacctgtttttaatgaagacgtacgacttatttttgtgttctgaacataagttctttgtcacataaaatgtgctatgaatgttgagttttaaatactccaaatgaatggctagagaattactatttgtagaaatatttatatgtcaaagggatgctaacaatttactttattgctctaaaatagaaaagttgccagaatgctgtggagttttagtggaaaacatgatagctggtgttactgagtaaatttgagtgttaaatgtcaatgtaagctaacggccaagatagggaccactgcagggtggttacttgcagctatgactcaactggtccttcactgccaaacatacctggggttggatcattggcctgacgtttgcaaattgaggaaccttagggcaaatcaatgaacttctgaactgccttcgtcttcagttatatggggatttccccacttttgaggtacttgtaaggattatatgagatgaagagatgagacaaggtatataaaagtcctagcacagagcgtgtcatataatatggcttcacaagtaccctcatctcctttccagtcgttttttgtttttgtttttgtttttttgagaccatctcactctgttgcccaggctggagtgcctcttcatttttatttctttattcagcaagtattgatcaaatgtgctttgtaccaggtactgagctcttcgttgggatataatggtgatcaaggagattgtagattctggcagggaaaactgacatcaaacacggcgacccgacatagtgagaccctgtctctactagaagaactttaaaaatcacctaggtgtgggccgggcacggtggctaacgcctgtaatcccagcactttgagatgctgaggcaggtggatcacgaggtcaggagatcgagaccatcctggataacacggagaaaccccgtctctactaaaaatacaaaaaaattagccgggcgtgggggcgggcatctgtagtcccaattactcgggaggctgcagcaggagaatggcatgaacccgggaggcggatcttgcattgagccaagatcacgccactgcactccagcctgggcgacagaatgagactccatctcaaaaaaaaagaagaaaccaaggatatagaataaaacaagagtgtagatttgggcattgaggccttcaaattggattgttctcaatgtccagaagaaaaaaaaaatttagaagagacccaaatcagaaaacaaaagttgggctgaattcaatgcgaattattttctagctcaatattaatactgcttatgtcagctgaatttcagcctttcaataacagctagtcaagtatttttttagttggttcctattgatcgtcatcttattttagtggaatccattatattgaagatgtcaagttcctcatttcccatacaaagaatgtgagattcatctttcttgaatctttgctaagtgttgaaggggacttttggcatcttttcaggaggactataattgggccctctaactaaaaagtctcctatgccccttagatagatgagatttttttttttgaccttgtacccaccaacattggtgggaggctcagaagggactgtgtttgtaactttgtagcactttctaaacagtgacctgttgtatgggcattataggacagtccgtggggtggggcgggggatgggggagatggacaaatgaggtctggtttaaagaatgagaagtgtgaccaggcatggtgactcatgcctgtaatccagcactttgggatgctgaggcaggaggatcacttgagcccaggagtttgaggttacagtaagctatgattgtgccactgggctccagcctgggtgacagaactagaccctgtctctaaaaaaagaagaagaggtgtgtatccttctaaatgataaaacagatcactcccctgcttacataaaactttccggtggctggccaggcacggtgtgtcacgcctgtaatcccagcactttgggaggccgtggtgggcagatcacgaggtcaggaaatcgagaccatcctggctaacgtggtgaaatcttgtctctactaaaaacacaaaaaattaacccaggtatggtggcatgcacctgtagtcccagctactcgggaggctgaggcaggagaatcgcttgaaccagggaggtggaggttgcagtgagctgagattgcgccactgcactccagcctgggtgacagagactctgtctcaaaaaa

SEQ ID NO: 436475 - DNA, 2708 bp, Homo sapiens
gggaatgaattggaagtaagcattatgatggtggtagaagcactatgtgaacttcattgtcctgaagctatacagggaattgctgtctggtcatcatctattgttggaaaacatcttctgtggattaactcagtggctcaacaggctgaagggaggtttgaaaaggcctctgtggagtaccaggaacacctgtgtgccatgacaggtgttgattgctgcatctccagctttgacaaatcggtgctcaccttagccagtgctgggtgtaagagtgccagcctgaaacattgtctgaatggtgaatccagaaaaagtgtgctgtccaaaccgactgactcttcccctgaggttataaattatttaggaaacaaagcatgtgagtgctacatctcaactgccgattgggctgctgtgcaggaatggcagaacgctatccatgacttgaaaaagagtaccagtagcacttccctcaacctgaaagctgacttcaactatataaaatcattaagcagctttgagtctggaaaatttgtcgaatgtaccgagcaattagaattgttaccaggagaaaatatcaatctacttgctggaggatcaaaagaaaaaatagacatgaaaaaactgcttcgtaacatgtgaagtccagatccaagggaacctcagaaatccattgaagttccattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcgtctgctttggagaccacagtttctaacagactttcaacagaggactgtcttattccactcttcggcgaagctttacgttcatgtaaacagcatgacgtgaggccgtggatgcaggcattaaggtatactgtgtaccagaatcagttgttggagaaaattaaagttaagtggttttccttttttttttttgtaagagaaaattaaaggtggttttttttttttaaattttgctttattgaggtttatattacacattctaagtgtatggtttgatgagttctaacatgtcttcacttgtgtgaccaccaatacgatcgagatagagaacagcgtcttaccccagaaggttcccttgggatcatctcctcatttgcccctgtcagcagttactgatttgctttctgtcactatggattagacttgtctttactaaagtttcatgtacgtgaaatcataacaacatgttctcttgtgtttggcttctcttgctcagcatgatatttttacggttcacccatattgcatgtatcaggaatataatcctttttattattgagtagtgttctattgtatgtatataccacagtttatttctcccttcatcctttgctagattttggggttttttcacattgcgctattcagtataaacctgctctcaacattcatcctgggcgacagaatgagactccatctcaaaaaaaaagaagaaaccaaggatatagaataaaacaagagtgtagatttgggcattgaggccttcaaattggattgttctcaatgtccagaagaaaaaaaaaatttagaagagacccaaatcagaaaacaaaagttgggctgaattcaatgcgaattattttctagctcaatattaatactgcttatgtcagctgaatttcagcctttcaataacagctagtcaagtatttttttagttggttcctattgatcgtcatcttattttagtggaatccattatattgaagatgtcaagttcctcatttcccatacaaagaatgtgagattcatctttcttgaatctttgctaagtgttgaaggggacttttggcatcttttcaggaggactataattgggccctctaactaaaaagtctcctatgccccttagatagatgagatttttttttttgaccttgtacccaccaacattggtgggaggctcagaagggactgtgtttgtaactttgtagcactttctaaacagtgacctgttgtatgggcattataggacagtccgtggggtggggcgggggatgggggagatggacaaatgaggtctggtttaaagaatgagaagtgtgaccaggcatggtgactcatgcctgtaatccagcactttgggatgctgaggcaggaggatcacttgagcccaggagtttgaggttacagtaagctatgattgtgccactgggctccagcctgggtgacagaactagaccctgtctctaaaaaaagaagaagaggtgtgtatccttctaaatgataaaacagatcactcccctgcttacataaaactttccggtggctggccaggcacggtgtgtcacgcctgtaatcccagcactttgggaggccgtggtgggcagatcacgaggtcaggaaatcgagaccatcctggctaacgtggtgaaatcttgtctctactaaaaacacaaaaaattaacccaggtatggtggcatgcacctgtagtcccagctactcgggaggctgaggcaggagaatcgcttgaaccagggaggtggaggttgcagtgagctgagattgcgccactgcactccagcctgggtgacagagactctgtctcaaaaaa

SEQ ID NO: 436476 - DNA, 2460 bp, Homo sapiens
acaaggtctggctctgttgcccaggttggagtgtaggagggcgatctcagctcactgtaacatcaacctcccaggctcaagcaatcctctcacttcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccactggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtaggtaaagaagggcagatttattagagaatgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttatttaagacagagtttcgctcttgttgcccaggctggagtgcagtggcacgatctcagctcaccacagcctccgcctcccaggttcaagcgattctcctgcctcagcctcccgagtagctgggattacaggcatgagccaccgtgcctggccagaaaattgtaaacacacacaaactctcaagtggcctaattccctctcaccaaaccaatcacaatacagataaaagagaataacttgtgttcatttttgtacaaacaaaaaagatataaattgtgaatgatgcatgatttttaattacaagtaaactgggcaaatgcttctgcattatttaaagctaaaaggtgatcagtggaaactttcctctgttagtactctaatactttttatatttatcggctcactacaacctgtgcctaccaggttcaagcgattctcctgtctcagccacctgagtagccgagaccacaggcacgcactaccatgtccggctaattttgtatttttaatagagacagggtttcaccgtgttggccatgctggtcttgaactcctgacctcaaccgatccgcctgccttggcctcccaaagttctgggattacaagcgtgagccacagcgcccagccttattataattgttactatttaaatctcttttgctctctccttcaagagagacctcatcccattcagttgcttccatttatttattcatcttctgcctcctgggctcgagagatcctccagcgtgagtctcccaagtagctgggactacaggctcacaccaccaagcttggctaaattttgtaggttttggagagacaggctcttgccacgttgcctaggctggtctcaaactcctgggctcagatgatccacctgccttcgcctcccaaagcactgggacatgagccaccacgcccagccgcaagtacttttacacaaaatgcaaacaccattcttccatcataaaagtgataccacagcttccgtgaagttttgccaggtagtactcataattaccttgggtaaactttttgatgttaaactgtatcttcttattacgagtttt

SEQ ID NO: 436477 - DNA, 2018 bp, Homo sapiens
gggaatgaattggaagtaagcattatgatggtggtagaagcactatgtgaacttcattgtcctgaagctatacagggaattgctgtctggtcatcatctattgttggaaaacatcttctgtggattaactcagtggctcaacaggctgaagggaggtttgaaaaggcctctgtggagtaccaggaacacctgtgtgccatgacaggtgttgattgctgcatctccagctttgacaaatcggtgctcaccttagccagtgctgggtgtaagagtgccagcctgaaacattgtctgaatggtgaatccagaaaaagtgtgctgtccaaaccgactgactcttcccctgaggttataaattatttaggaaacaaagcatgtgagtgctacatctcaactgccgattgggctgctgtgcaggaatggcagaacgctatccatgacttgaaaaagagtaccagtagcacttccctcaacctgaaagctgacttcaactatataaaatcattaagcagctttgagtctggaaaatttgtcgaatgtaccgagcaattagaattgttaccaggagaaaatatcaatctacttgctggaggatcaaaagaaaaaatagacatgaaaaaactgcttcgtaacatgtgaagtccagatccaagggaacctcagaaatccattgaagttccattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcgtctgctttggagaccacagtttctaacagactttcaacagaggactgtcttattccactcttcggcgaagctttacgttcatgtaaacagcatgacgtgaggccgtggatgcaggcattaaggtatactgtgtaccagaatcagttgttggagaaaattaaagttaagtggttttccttttttttttttgtaagagaaaattaaaggtggttttttttttttaaattttgctttattgaggtttatattacacattctaagtgtatggtttgatgagttctaacatgtcttcacttgtgtgaccaccaatacgatcgagatagagaacagcgtcttaccccagaaggttcccttgggatcatctcctcatttgcccctgtcagcagttactgatttgctttctgtcactatggattagacttgtctttactaaagtttcatgtacgtgaaatcataacaacatgttctcttgtgtttggcttctcttgctcagcatgatatttttacggttcacccatattgcatgtatcaggaatataatcctttttattattgagtagtgttctattgtatgtatataccacagtttatttctcccttcatcctttgctagattttggggttttttcacattgcgctattcagtataaacctgctctcaacattcatgtgcaagtctttgagtggacatatatttgcgtttctcttgagtgaatgcaccttgttgggtcacgtggcttaacttaaaaaaattttaatcactgtggtgcatatgtagtgattattagtgattatctcataattttattttcttgtttaatgatgttgagtgtatttcatttgtattttagtttgcaaatgtttgttcaaattcttcacctgtttttaatgaagacgtacgacttatttttgtgttctgaacataagttctttgtcacataaaatgtgctatgaatgttgagttttaaatactcgtgcagtggctcacacctgtattcccagcactttgggaggccaaggcaggtggatcatgaggtcaggagttggagaccagcctggccaagatggtgaaaccctgtttctactaaaaatacaaaaattagccgagcgtggtggcaggcgcctgtaatcccagttactca

SEQ ID NO: 436478 - DNA, 1693 bp, Homo sapiens
acgggtagattttggaacattttggattttattctttttttttgagacagagttttgcttctgttgcccaggctggagtgcctcttcatttttatttctttattcagcaagtattgatcaaatgtgctttgtaccaggtactgagctcttcgttgggatataatggtgatcaaggagattgtagattctggcagggaaaactgacatcaaacacggcgacccgacatagtgagaccctgtctctactagaagaactttaaaaatcacctaggtgtgggccgggcacggtggctaacgcctgtaatcccagcactttgagatgctgaggcaggtggatcacgaggtcaggagatcgagaccatcctggataacacggagaaaccccgtctctactaaaaatacaaaaaaattagccgggcgtgggggcgggcatctgtagtcccaattactcgggaggctgcagcaggagaatggcatgaacccgggaggcggatcttgcattgagccaagatcacgccactgcactccagcctgggcgacagaatgagactccatctcaaaaaaaaagaagaaaccaaggatatagaataaaacaagagtgtagatttgggcattgaggccttcaaattggattgttctcaatgtccagaagaaaaaaaaaatttagaagagacccaaatcagaaaacaaaagttgggctgaattcaatgcgaattattttctagctcaatattaatactgcttatgtcagctgaatttcagcctttcaataacagctagtcaagtatttttttagttggttcctattgatcgtcatcttattttagtggaatccattatattgaagatgtcaagttcctcatttcccatacaaagaatgtgagattcatctttcttgaatctttgctaagtgttgaaggggacttttggcatcttttcaggaggactataattgggccctctaactaaaaagtctcctatgccccttagatagatgagatttttttttttgaccttgtacccaccaacattggtgggaggctcagaagggactgtgtttgtaactttgtagcactttctaaacagtgacctgttgtatgggcattataggacagtccgtggggtggggcgggggatgggggagatggacaaatgaggtctggtttaaagaatgagaagtgtgaccaggcatggtgactcatgcctgtaatccagcactttgggatgctgaggcaggaggatcacttgagcccaggagtttgaggttacagtaagctatgattgtgccactgggctccagcctgggtgacagaactagaccctgtctctaaaaaaagaagaagaggtgtgtatccttctaaatgataaaacagatcactcccctgcttacataaaactttccggtggctggccaggcacggtgtgtcacgcctgtaatcccagcactttgggaggccgtggtgggcagatcacgaggtcaggaaatcgagaccatcctggctaacgtggtgaaatcttgtctctactaaaaacacaaaaaattaacccaggtatggtggcatgcacctgtagtcccagctactcgggaggctgaggcaggagaatcgcttgaaccagggaggtggaggttgcagtgagctgagattgcgccactgcactccagcctgggtgacagagactctgtctcaaaaaa

SEQ ID NO: 436479 - DNA, 2404 bp, Homo sapiens
ttttttgagacagagactcactctgtcacccaggctggagtgcagtggcatgattttggctcactgcaacctccacctcctgagttcaaacaattatcctgcctcatccttcggagtacctgggattacaggtgcgtgccaccgtgcccggctcatttttgtattcttagtagagacggcatttcaccatgttggccaggctggtctcaaactcctggcctcaactgatccactctcattggccttccaaggtgctgggattataggcgtgagccaccacaactggctcagtaaatacattttttattatcaaaaaagagtagtgtatggttggcgtattctgtgtagaatgtattttattgatgtctcctatttttataatttctgagttaagtactttttaattaatgctttttagttttgggcagattcagttgactaaagcacctcatttcccagatacatgaaataaaatatttggcttcttttccaatttcacactgatgttattttgtgaaaatcagtgctttaagataaatcgttatacgttaagataaacatgagaaacttgatctaatatttaatatttattcagttctacactttattaacttctacaccagcagatttagacattatgtaaccatctcaagaagtttcacttggatgtaatgcttcacgcttgtaatcccagcactttaggaggctgaggtgggaggactgcttaaggcaaggagtctgagaccagcctgggcaatacagcaagatcccatctctattttaaagaaaagtttcactttgggaggccaaggcgggtggatcacaaggtgagtttgagaccagcctaggcaacgtggcaagagcctgtctctccaaaacctacaaaatttagccaagcttggtggtgtgagcctgtagtcccagctacttgggagactcacgctggaggatctctcgagcccaggaggcagaagatgaataaataaatggaagcaactgaatgggatgaggtctctcttgaaggagagagcaaaagagatttaaatagtaacaattataataaggctgggcgcggtggctcacgcttgtaatcccagaactttgggaggccaaggcaggcggatcggttgaggtcaggagttcaagaccagcatggccaacacggtgaaaccctgtctctattaaaaatacaaaattagccggacatggtagtgcgtgcctgtggtctcggctactcaggtggctgagacaggagaatcgcttgaacctggtaggcacaggttgtagtgagccgataaatataaaaagtattagagtactaacagaggaaagtttccactgatcaccttttagctttaaataatgcagaagcatttgcccagtttacttgtaattaaaaatcatgcatcattcacaatttatatcttttttgtttgtacaaaaatgaacacaagttattctcttttatctgtattgtgattggtttggtgagagggaattaggccacttgagagtttgtgtgtgtttacaattttctggccaggcacggtggctcatgcctgtaatcccagcactttgggaggccaaggcgggcggatcacttgagctcaggagttcgagaccaaattgggcaacatggtgaaaccctatctctacgaaaaatacaaaaattagctgagtgccgtggcttgcgcctgtcctcccagctacttggggggctgaggcagtaggatcgctcaagcccaggaggtggaggttgcagtgagccaagatcacgtcactgcactccaggaagggcaacagagcaagactccttctaaaaaaaaaaaaaaaaaaagaaagaaagaaaagaaaattaactttggtatttcaggttgtatttaaatggagacttaacatgaactatgttcataacacttgaccaaattaagtgtagatcgtctctttaataaagagatcatctggaactgcaatttctaactcatacatcattgctacaaaccttatttgtttactatttctcttccaaggaccatcagtcatcctttaaaattcatttcaagctctgaaaagatattttttgttacatgggcaatttacttttagtacagtaaaatgttatgtgaatttctacagtatgtttgccaaaatgaattatatctagaatacgcttaacaatatattctggaggcagctttcatttgaaattaggttcaccttctgagagtatgaaaaagttaatgggtttttgtgcctgaagattttgatgttgcatttggctacatttaatccactttcacccataagttttaacatctaaaaaaattaaatcactgctaatgcaattaaaatgcattatgaaatgcatttctgtccaggctggagtgcagtggcacaatctcgg

SEQ ID NO: 436480 - DNA, 1826 bp, Homo sapiens
gtgggcggatcacaaggtcaggagttccagaccagcctggccaatatggtgaaaccctgtctctaataaaatacaaaaattagccgggtgtggtggtgggcgcctgtagtcccacctacttgggaggctgaggcaggagaatagtttgaacccgggaggcagagtctgcagtgagccgagattgcaccactgcactccagcctaggcgacagagcgagactctgtctcaaaaacagcaacaactacaaacaaacaaaaaacagggttaacaaaagtatggaattcaattctttttatatgctgcagccatgttcctgccctagatttggctgggcatgtggctcagtaaatacattttttattatcaaaaaagagtagtgtatggttggcgtattctgtgtagaatgtattttattgatgtctcctatttttataatttctgagttaagtactttttaattaatgctttttagttttgggcagattcagttgactaaagcacctcatttcccagatacatgaaataaaatatttggcttcttttccaatttcacactgatgttattttgtgaaaatcagtgctttaagataaatcgttatacgttaagataaacatgagaaacttgatctaatatttaatatttattcagttctacactttattaacttctacaccagcagatttagacattatgtaaccatctcaagaagtttcacttggatgtaatgcttcacgcttgtaatcccagcactttaggaggctgaggtgggaggactgcttaaggcaaggagtctgagaccagcctgggcaatacagcaagatcccatctctattttaaagaaaagtttcactttgggaggccaaggcgggtggatcacaaggtgcatgagccaccgtgcctggccagaaaattgtaaacacacacaaactctcaagtggcctaattccctctcaccaaaccaatcacaatacagataaaagagaataacttgtgttcatttttgtacaaacaaaaaagatataaattgtgaatgatgcatgatttttaattacaagtaaactgggcaaatgcttctgcattatttaaagctaaaaggtgatcagtggaaactttcctctgttagtactctaatactttttatatttatcggctcactacaacctgtgcctaccaggttcaagcgattctcctgtctcagccacctgagtagccgagaccacaggcacgcactaccatgtccggctaattttgtatttttaatagagacagggtttcaccgtgttggccatgctggtcttgaactcctgacctcaaccgatccgcctgccttggcctcccaaagttctgggattacaagcgtgagccacagcgcccagccttattataattgttactatttaaatctcttttgctctctccttcaagagagacctcatcccattcagttgcttccatttatttattcatcttctgcctcctgggctcgagagatcctccagcgtgagtctcccaagtagctgggactacaggctcacaccaccaagcttggctaaattttgtaggttttggagagacaggctcttgccacgttgcctaggctggtctcaaactcctgggctcagatgatccacctgccttcgcctcccaaagcactgggacatgagccaccacgcccagccgcaagtacttttacacaaaatgcaaacaccattcttccatcataaaagtgataccacagcttccgtgaagttttgccaggtagtactcataattaccttgggtaaactttttgatgttaaactgtatcttcttattacgagtttt

SEQ ID NO: 436481 - DNA, 1896 bp, Homo sapiens
ttttttgagacagagactcactctgtcacccaggctggagtgcagtggcatgattttggctcactgcaacctccacctcctgagttcaaacaattatcctgcctcatccttcggagtacctgggattacaggtgcgtgccaccgtgcccggctcatttttgtattcttagtagagacggcatttcaccatgttggccaggctggtctcaaactcctggcctcaactgatccactctcattggccttccaaggtgctgggattataggcgtgagccaccacaactggctcagtaaatacattttttattatcaaaaaagagtagtgtatggttggcgtattctgtgtagaatgtattttattgatgtctcctatttttataatttctgagttaagtactttttaattaatgctttttagttttgggcagattcagttgactaaagcacctcatttcccagatacatgaaataaaatatttggcttcttttccaatttcacactgatgttattttgtgaaaatcagtgctttaagataaatcgttatacgttaagataaacatgagaaacttgatctaatatttaatatttattcagttctacactttattaacttctacaccagcagatttagacattatgtaaccatctcaagaagtttcacttggatgtaatgcttcacgcttgtaatcccagcactttaggaggctgaggtgggaggactgcttaaggcaaggagtctgagaccagcctgggcaatacagcaagatcccatctctattttaaagaaaagtttcactttgggaggccaaggcgggtggatcacaaggtgagtttgagaccagcctaggcaacgtggcaagagcctgtctctccaaaacctacaaaatttagccaagcttggtggtgtgagcctgtagtcccagctacttgggagactcacgctggaggatctctcgagcccaggaggcagaagatgaataaataaatggaagcaactgaatgggatgaggtctctcttgaaggagagagcaaaagagatttaaatagtaacaattataataaggctgggcgcggtggctcacgcttgtaatcccagaactttgggaggccaaggcaggcggatcggttgaggtcaggagttcaagaccagcatggccaacacggtgaaaccctgtctctattaaaaatacaaaattagccggacatggtagtgcgtgcctgtggtctcggctactcaggtggctgagacaggagaatcgcttgaacctggtaggcacaggttgtagtgagccgataaatataaaaagtattagagtactaacagaggaaagtttccactgatcaccttttagctttaaataatgcagaagcatttgcccagtttacttgtaattaaaaatcatgcatcattcacaatttatatcttttttgtttgtacaaaaatgaacacaagttattctcttttatctgtattgtgattggtttggtgagagggaattaggccacttgagagtttgtgtgtgtttacaattttctggccaggcacggtggctcatgcctgtaatcccagcactttgggaggccaaggcgggcggatcacttgagctcaggagttcgagaccaaattgggcaacatggtgaaaccctatctctacgaaaaatacaaaaattagctggatgtggtggcagcacttgtagtcccagctacttgggtggctgaggcaggagaatggcgtgaacccgggaggcagagtttgcagtgagccgagatcccaccactgcactccagcttaggcgacagagccagactgtgtctcaaaaacaggaaagaaaacaaaagaaaatttggactattgccaattacaaatatttttagagaagaattcaaaacagta

SEQ ID NO: 436482 - DNA, 2002 bp, Homo sapiens
  misc_feature (1212)..(1212): n is a, c, g, or t
  misc_feature (1464)..(1464): n is a, c, g, or t
gagacagagtctcactctgtcacccaggctagagtgcagtggcatgatcttggctcactgcaacctccacctcccaggttcaagcgattcttatccctcagcctcttgagtagctgggactacaggcatatgccaccatgcccggataatttttgtatttttagtagaggcggggtttcaccatattggccaagctggtctagaactcctgacatgatccgcacacctcggcctcccaatgtgctgggattacctccagattcattttcacagtctttcatgttttggtcatatgacattgtattttgctgccatatgactgatctttttttgttaaatgtgagatacttgttaaaaaatgtttagcaatgaattgaggcctagtagcatgttatcttgctgcagaagagatgggagtctacttctgggggatggtcaggggtcctccatacaagctgcaattgaagtcgtcggtgcaggctcagtccctacaaaggccagggtatttcctgtccacctttattctgatgcatgactcttctgggtctcaaccagagccagcggacttcagtatgggtcgctttcattggcagaccctcaatccacttgttttccatctaatcccacgcatgtgtgcaaaagctgctgtgcttctttgcatctcagtagttccttctggaattcagcaatgaactcagggaaatgggttccaaatgcgaggctgactttcgtcctgggtttccttcttctccatcttcacctcatgtctgtttactgccatgttagcaatttgatgtattcaatcatgggttttatattctgtttggtgtcccccattgttctcattggagatcagaagcttcagatgcacttatgtcaactcaagagtagaatgcttccttagcttccctccagagtcaggttttgtgtttctagttcccaagtgcacagcaggagtagtgatgtcctcactggcttctcatttgcattaagctgtgagcttctttagcgtggggacaggaccctgctcccattgcattctcagcaccacaccacacactccttgtttgaggccactccagacagcatgtgctgaaggatgccttgtggtcagaaacaagttcattaactttctctttgaagtgttttcgcccctgtttcctagcgttctgggaattttacacatccttcctataaagccaagtatcaggngagatccttaggatcaggaccatgaatcaagtggtgtgagggcaacacagcaaacttaccctttttaggccgtttcctttttctgccctcaatctctgtgaactgaaccttgttaaagtcagtcaacaccagggtggatggtttgccgttgtcacctattttcaggacataacaccctgacttaggagccattccgatcatttctaattcaatagatgcgcccagcattcagattgccttttctctcaaccnggatctttaaagttgatgacaagagttccagtcctgaatcatggcaaagtgcagtagtgaactgcggggttattctggaaggatctctctatggctgatggtctcagttccggcatcaacctctgactgagaatcaggtctcacacaggaggagtcagatgaggagcaatcctctgcttccgatggagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatga

SEQ ID NO: 436483 - DNA, 1917 bp, Homo sapiens
tgtataatttatctgaatgtaataggcattaatatattttacattactgggaccatagtacagaaatttctaaatggtttgtaaaataacttgttatttgtgttgttgtaaaagcagttaatacaatggaaaaactcgtaataagaagatacagtttaacatcaaaaagtttacccaaggtaattatgagtactacctggcaaaacttcacggaagctgtggtatcacttttatgatggaagaatggtgtttgcattttgtgtaaaagtacttgcggctgggcgtggtggctcatgtcccagtgctttgggaggcgaaggcaggtggatcatctgagcccaggagtttgagaccagcctaggcaacgtggcaagagcctgtctctccaaaacctacaaaatttagccaagcttggtggtgtgagcctgtagtcccagctacttgggagactcacgctggaggatctctcgagcccaggaggcagaagatgaataaataaatggaagcaactgaatgggatgaggtctctcttgaaggagagagcaaaagagatttaaatagtaacaattataataaggctgggcgcggtggctcacgcttgtaatcccagaactttgggaggccaaggcaggcggatcggttgaggtcaggagttcaagaccagcatggccaacacggtgaaaccctgtctctattaaaaatacaaaattagccggacatggtagtgcgtgcctgtggtctcggctactcaggtggctgagacaggagaatcgcttgaacctggtaggcacaggttgtagtgagccgataaatataaaaagtattagagtactaacagaggaaagtttccactgatcaccttttagctttaaataatgcagaagcatttgcccagtttacttgtaattaaaaatcatgcatcattcacaatttatatcttttttgtttgtacaaaaatgaacacaagttattctcttttatctgtattgtgattggtttggtgagagggaattaggccacttgagagtttgtgtgtgtttacaattttctggccaggcacggtggctcatgcctgtaatcccagcactttgggaggccaaggcgggcggatcacttgagctcaggagttcgagaccaaattgggcaacatggtgaaaccctatctctacgaaaaatacaaaaattagctgagtgccgtggcttgcgcctgtcctcccagctacttggggggctgaggcagtaggatcgctcaagcccaggaggtggaggttgcagtgagccaagatcacgtcactgcactccaggaagggcaacagagcaagactccttctaaaaaaaaaaaaaaaaaaagaaagaaagaaaagaaaattaactttggtatttcaggttgtatttaaatggagacttaacatgaactatgttcataacacttgaccaaattaagtgtagatcgtctctttaataaagagatcatctggaactgcaatttctaactcatacatcattgctacaaaccttatttgtttactatttctcttccaaggaccatcagtcatcctttaaaattcatttcaagctctgaaaagatattttttgttacatgggcaatttacttttagtacagtaaaatgttatgtgaatttctacagtatgtttgccaaaatgaattatatctagaatacgcttaacaatatattctggaggcagctttcatttgaaattaggttcaccttctgagagtatgaaaaagttaatgggtttttgtgcctgaagattttgatgttgcatttggctacatttaatccactttcacccataagttttaacatctaaaaaaattaaatcactgctaatgcaattaaaatgcattatgaaatgcatttctgtccaggctggagtgcagtggcacaatctcgg

SEQ ID NO: 436484 - DNA, 1429 bp, Homo sapiens
atctgctgttctcttcgcctggacacctcttggttctttttttttttgttctttgagatggagtctcactctgttgcccaggctggagtgcagtggcgcgatttcggctcactgcaaccccgtctctactaaaaatacaaaaaaattagccgggcgtgggggcgggcatctgtagtcccaattactcgggaggctgcagcaggagaatggcatgaacccgggaggcggatcttgcattgagccaagatcacgccactgcactccagcctgggcgacagaatgagactccatctcaaaaaaaaagaagaaaccaaggatatagaataaaacaagagtgtagatttgggcattgaggccttcaaattggattgttctcaatgtccagaagaaaaaaaaaatttagaagagacccaaatcagaaaacaaaagttgggctgaattcaatgcgaattattttctagctcaatattaatactgcttatgtcagctgaatttcagcctttcaataacagctagtcaagtatttttttagttggttcctattgatcgtcatcttattttagtggaatccattatattgaagatgtcaagttcctcatttcccatacaaagaatgtgagattcatctttcttgaatctttgctaagtgttgaaggggacttttggcatcttttcaggaggactataattgggccctctaactaaaaagtctcctatgccccttagatagatgagatttttttttttgaccttgtacccaccaacattggtgggaggctcagaagggactgtgtttgtaactttgtagcactttctaaacagtgacctgttgtatgggcattataggacagtccgtggggtggggcgggggatgggggagatggacaaatgaggtctggtttaaagaatgagaagtgtgaccaggcatggtgactcatgcctgtaatccagcactttgggatgctgaggcaggaggatcacttgagcccaggagtttgaggttacagtaagctatgattgtgccactgggctccagcctgggtgacagaactagaccctgtctctaaaaaaagaagaagaggtgtgtatccttctaaatgataaaacagatcactcccctgcttacataaaactttccggtggctggccaggcacggtgtgtcacgcctgtaatcccagcactttgggaggccgtggtgggcagatcacgaggtcaggaaatcgagaccatcctggctaacgtggtgaaatcttgtctctactaaaaacacaaaaaattaacccaggtatggtggcatgcacctgtagtcccagctactcgggaggctgaggcaggagaatcgcttgaaccagggaggtggaggttgcagtgagctgagattgcgccactgcactccagcctgggtgacagagactctgtctcaaaaaa

SEQ ID NO: 436485 - DNA, 1307 bp, Homo sapiens
tactactaaattcgcggccgcgtcgacccgggcgtgggggcgggcatctgtagtcccaattactcgggaggctgcagcaggagaatggcatgaacccgggaggcggatcttgcattgagccaagatcacgccactgcactccagcctgggcgacagaatgagactccatctcaaaaaaaaagaagaaaccaaggatatagaataaaacaagagtgtagatttgggcattgaggccttcaaattggattgttctcaatgtccagaagaaaaaaaaaatttagaagagacccaaatcagaaaacaaaagttgggctgaattcaatgcgaattattttctagctcaatattaatactgcttatgtcagctgaatttcagcctttcaataacagctagtcaagtatttttttagttggttcctattgatcgtcatcttattttagtggaatccattatattgaagatgtcaagttcctcatttcccatacaaagaatgtgagattcatctttcttgaatctttgctaagtgttgaaggggacttttggcatcttttcaggaggactataattgggccctctaactaaaaagtctcctatgccccttagatagatgagatttttttttttgaccttgtacccaccaacattggtgggaggctcagaagggactgtgtttgtaactttgtagcactttctaaacagtgacctgttgtatgggcattataggacagtccgtggggtggggcgggggatgggggagatggacaaatgaggtctggtttaaagaatgagaagtgtgaccaggcatggtgactcatgcctgtaatccagcactttgggatgctgaggcaggaggatcacttgagcccaggagtttgaggttacagtaagctatgattgtgccactgggctccagcctgggtgacagaactagaccctgtctctaaaaaaagaagaagaggtgtgtatccttctaaatgataaaacagatcactcccctgcttacataaaactttccggtggctggccaggcacggtgtgtcacgcctgtaatcccagcactttgggaggccgtggtgggcagatcacgaggtcaggaaatcgagaccatcctggctaacgtggtgaaatcttgtctctactaaaaacacaaaaaattaacccaggtatggtggcatgcacctgtagtcccagctactcgggaggctgaggcaggagaatcgcttgaaccagggaggtggaggttgcagtgagctgagattgcgccactgcactccagcctgggtgacagagactctgtctcaaaaaa

SEQ ID NO: 436486 - DNA, 1296 bp, Homo sapiens
ttaacattttgtttttttgtaggtttcaggcacagaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatga

SEQ ID NO: 436487 - DNA, 705 bp, Homo sapiens
atgtactagaggatcccgcactcgcgtgtcattaccctctggatagcttaccttatgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatga

SEQ ID NO: 436488 - DNA, 335 bp, Homo sapiens
tattctttgagtggttatgaattgtaatttttattaattgacagtaaatattttgtttcagaaatgtggtaaagtacttgaagcaaacatcccgcatcgctattggacctctgagactttctactttaacagtttcacagtctttgccagttctaagtaccttgcagctgtattgctcgtctgctttggagaccacagtttctaacagactttcaacagaggtctgtatatttttacaagcacactcttatgactattaatggtcattactgtagaacaaagaccttattttttgagttttttggaataggatttgtagttgggcaagctggtaa

SEQ ID NO: 436489 - DNA, 457 bp, Homo sapiens
tcccaaggtgctgggactacaggtgtgtgccaccagctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcag

SEQ ID NO: 436490 - DNA, 3636 bp, Homo sapiens
gggaatgaattggaagtaagcattatgatggtggtagaagcactatgtgaacttcattgtcctgaagctatacagggaattgctgtctggtcatcatctattgttggaaaacatcttctgtggattaactcagtggctcaacaggctgaagggaggtttgaaaaggcctctgtggagtaccaggaacacctgtgtgccatgacaggtgttgattgctgcatctccagctttgacaaatcggtgctcaccttagccagtgctgggtgtaagagtgccagcctgaaacattgtctgaatggtgaatccagaaaaagtgtgctgtccaaaccgactgactcttcccctgaggttataaattatttaggaaacaaagcatgtgagtgctacatctcaactgccgattgggctgctgtgcaggaatggcagaacgctatccatgacttgaaaaagagtaccagtagcacttccctcaacctgaaagctgacttcaactatataaaatcattaagcagctttgagtctggaaaatttgtcgaatgtaccgagcaattagaattgttaccaggagaaaatatcaatctacttgctggaggatcaaaagaaaaaatagacatgaaaaaactgcttcgtaacatgtgaagtccagatccaagggaacctcagaaatccattgaagttccattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcgtctgctttggagaccacagtttctaacagactttcaacagaggactgtcttattccactcttcggcgaagctttacgttcatgtaaacagcatgacgtgaggccgtggatgcaggcattaaggtatactgtgtaccagaatcagttgttggagaaaattaaagttaagtggttttccttttttttttttgtaagagaaaattaaaggtggttttttttttttaaattttgctttattgaggtttatattacacattctaagtgtatggtttgatgagttctaacatgtcttcacttgtgtgaccaccaatacgatcgagatagagaacagcgtcttaccccagaaggttcccttgggatcatctcctcatttgcccctgtcagcagttactgatttgctttctgtcactatggattagacttgtctttactaaagtttcatgtacgtgaaatcataacaacatgttctcttgtgtttggcttctcttgctcagcatgatatttttacggttcacccatattgcatgtatcaggaatataatcctttttattattgagtagtgttctattgtatgtatataccacagtttatttctcccttcatcctttgctagattttggggttttttcacattgcgctattcagtataaacctgctctcaacattcatgtgcaagtctttgagtggacatatatttgcgtttctcttgagtgaatgcaccttgttgggtcacgtggcttaacttaaaaaaattttaatcactgtggtgcatatgtagtgattattagtgattatctcataattttattttcttgtttaatgatgttgagtgtatttcatttgtattttagtttgcaaatgtttgttcaaattcttcacctgtttttaatgaagacgtacgacttatttttgtgttctgaacataagttctttgtcacataaaatgtgctatgaatgttgagttttaaatactccaaatgaatggctagagaattactatttgtagaaatatttatatgtcaaagggatgctaacaatttactttattgctctaaaatagaaaagttgccagaatgctgtggagttttagtggaaaacatgatagctggtgttactgagtaaatttgagtgttaaatgtcaatgtaagctaacggccaagatagggaccactgcagggtggttacttgcagctatgactcaactggtccttcactgccaaacatacctggggttggatcattggcctgacgtttgcaaattgaggaaccttagggcaaatcaatgaacttctgaactgccttcgtcttcagttatatggggatttccccacttttgaggtacttgtaaggattatatgagatgaagagatgagacaaggtatataaaagtcctagcacagagcgtgtcatataatatggcttcacaagtaccctcatctcctttccagtcgttttttgtttttgtttttgtttttttgagaccatctcactctgttgcccaggctggagtgcctcttcatttttatttctttattcagcaagtattgatcaaatgtgctttgtaccaggtactgagctcttcgttgggatataatggtgatcaaggagattgtagattctggcagggaaaactgacatcaaacacggcgacccgacatagtgagaccctgtctctactagaagaactttaaaaatcacctaggtgtgggccgggcacggtggctaacgcctgtaatcccagcactttgagatgctgaggcaggtggatcacgaggtcaggagatcgagaccatcctggataacacggagaaaccccgtctctactaaaaatacaaaaaaattagccgggcgtgggggcgggcatctgtagtcccaattactcgggaggctgcagcaggagaatggcatgaacccgggaggcggatcttgcattgagccaagatcacgccactgcactccagcctgggcgacagaatgagactccatctcaaaaaaaaagaagaaaccaaggatatagaataaaacaagagtgtagatttgggcattgaggccttcaaattggattgttctcaatgtccagaagaaaaaaaaaatttagaagagacccaaatcagaaaacaaaagttgggctgaattcaatgcgaattattttctagctcaatattaatactgcttatgtcagctgaatttcagcctttcaataacagctagtcaagtatttttttagttggttcctattgatcgtcatcttattttagtggaatccattatattgaagatgtcaagttcctcatttcccatacaaagaatgtgagattcatctttcttgaatctttgctaagtgttgaaggggacttttggcatcttttcaggaggactataattgggccctctaactaaaaagtctcctatgccccttagatagatgagatttttttttttgaccttgtacccaccaacattggtgggaggctcagaagggactgtgtttgtaactttgtagcactttctaaacagtgacctgttgtatgggcattataggacagtccgtggggtggggcgggggatgggggagatggacaaatgaggtctggtttaaagaatgagaagtgtgaccaggcatggtgactcatgcctgtaatccagcactttgggatgctgaggcaggagaacagcatgaacccgggagccacagcacgcagttagcccatgatcgcgccactgcaacccatctcgacgttatgtagactaatactatta

SEQ ID NO: 436491 - DNA, 2964 bp, Homo sapiens
  misc_feature (1107)..(1107): n is a, c, g, or t
  misc_feature (1157)..(1157): n is a, c, g, or t
  misc_feature (1163)..(1163): n is a, c, g, or t
  misc_feature (1396)..(1396): n is a, c, g, or t
  misc_feature (1434)..(1434): n is a, c, g, or t
  misc_feature (1486)..(1486): n is a, c, g, or t
  misc_feature (1492)..(1492): n is a, c, g, or t
  misc_feature (1514)..(1514): n is a, c, g, or t
gggaatgaattggaagtaagcattatgatggtggtagaagcactatgtgaacttcattgtcctgaagctatacagggaattgctgtctggtcatcatctattgttggaaaacatcttctgtggattaactcagtggctcaacaggctgaagggaggtttgaaaaggcctctgtggagtaccaggaacacctgtgtgccatgacaggtgttgattgctgcatctccagctttgacaaatcggtgctcaccttagccagtgctgggtgtaagagtgccagcctgaaacattgtctgaatggtgaatccagaaaaagtgtgctgtccaaaccgactgactcttcccctgaggttataaattatttaggaaacaaagcatgtgagtgctacatctcaactgccgattgggctgctgtgcaggaatggcagaacgctatccatgacttgaaaaagagtaccagtagcacttccctcaacctgaaagctgacttcaactatataaaatcattaagcagctttgagtctggaaaatttgtcgaatgtaccgagcaattagaattgttaccaggagaaaatatcaatctacttgctggaggatcaaaagaaaaaatagacatgaaaaaactgcttcgtaacatgtgaagtccagatccaagggaacctcagaaatccattgaagttccattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcgtctgctttggagaccacagtttctaacagactttcaacagaggactgtcttattccactcttcggcgaagctttacgttcatgtaaacagcatgacgtgaggccgtggatgcaggcattaagggatctcgtgaaatcttgagagaaactgaatgacgaatgaaactatgttcctgtttcacacggaagaaaactgaggttaaacaggggttggcactcatcatgagccccngttctcattctgcaaatggtgaagctctctattgtcctgaccccacagtncctgtnccatgaccagggccagctcacaaggagctgcgcagcatgtaaagtcagtgacatgcccatgcgagtacctgaggaaggtgagtgagtgcagacagatggggcctggtgccttgagcagttcccgggtctcagctgccacacatctcatagccggtgatgctgggggaagcttacgcagtcacagtactggcttcttcctctttttctttccatacaagtggcttagggatggnggtagagtagttgacttatttggatgaaaaccactatnttctgttcagaaacttcaaaaggaatcattgctgggctggtaacctaaaganaaacanccagacaagtgcccaacgacanttaaaaaggtgatttattatcttgccaagtgtgggccgggcacggtggctaacgcctgtaatcccagcactttgagatgctgaggcaggtggatcacgaggtcaggagatcgagaccatcctggataacacggagaaaccccgtctctactaaaaatacaaaaaaattagccgggcgtgggggcgggcatctgtagtcccaattactcgggaggctgcagcaggagaatggcatgaacccgggaggcggatcttgcattgagccaagatcacgccactgcactccagcctgggcgacagaatgagactccatctcaaaaaaaaagaagaaaccaaggatatagaataaaacaagagtgtagatttgggcattgaggccttcaaattggattgttctcaatgtccagaagaaaaaaaaaatttagaagagacccaaatcagaaaacaaaagttgggctgaattcaatgcgaattattttctagctcaatattaatactgcttatgtcagctgaatttcagcctttcaataacagctagtcaagtatttttttagttggttcctattgatcgtcatcttattttagtggaatccattatattgaagatgtcaagttcctcatttcccatacaaagaatgtgagattcatctttcttgaatctttgctaagtgttgaaggggacttttggcatcttttcaggaggactataattgggccctctaactaaaaagtctcctatgccccttagatagatgagatttttttttttgaccttgtacccaccaacattggtgggaggctcagaagggactgtgtttgtaactttgtagcactttctaaacagtgacctgttgtatgggcattataggacagtccgtggggtggggcgggggatgggggagatggacaaatgaggtctggtttaaagaatgagaagtgtgaccaggcatggtgactcatgcctgtaatccagcactttgggatgctgaggcaggaggatcacttgagcccaggagtttgaggttacagtaagctatgattgtgccactgggctccagcctgggtgacagaactagaccctgtctctaaaaaaagaagaagaggtgtgtatccttctaaatgataaaacagatcactcccctgcttacataaaactttccggtggctggccaggcacggtgtgtcacgcctgtaatcccagcactttgggaggccgtggtgggcagatcacgaggtcaggaaatcgagaccatcctggctaacgtggtgaaatcttgtctctactaaaaacacaaaaaattaacccaggtatggtggcatgcacctgtagtcccagctactcgggaggctgaggcaggagaatcgcttgaaccagggaggtggaggttgcagtgagctgagattgcgccactgcactccagcctgggtgacagagactctgtctcaaaaaa

SEQ ID NO: 436492 - DNA, 1771 bp, Homo sapiens
ttttttgagacagagactcactctgtcacccaggctggagtgcagtggcatgattttggctcactgcaacctccacctcctgagttcaaacaattatcctgcctcatccttcggagtacctgggattacaggtgcgtgccaccgtgcccggctcatttttgtattcttagtagagacggcatttcaccatgttggccaggctggtctcaaactcctggcctcaactgatccactctcattggccttccaaggtgctgggattataggcgtgagccaccacaactggctcagtaaatacattttttattatcaaaaaagagtagtgtatggttggcgtattctgtgtagaatgtattttattgatgtctcctatttttataatttctgagttaagtactttttaattaatgctttttagttttgggcagattcagttgactaaagcacctcatttcccagatacatgaaataaaatatttggcttcttttccaatttcacactgatgttattttgtgaaaatcagtgctttaagataaatcgttatacgttaagataaacatgagaaacttgatctaatatttaatatttattcagttctacactttattaacttctacaccagcagatttagacattatgtaaccatctcaagaagtttcacttggatgtaatgcttcacgcttgtaatcccagcactttaggaggctgaggtgggaggactgcttaaggcaaggagtctgagaccagcctgggcaatacagcaagatcccatctctattttaaagaaaagtttcactttgggaggccaaggcgggtggatcacaaggtgcatgagccaccgtgcctggccagaaaattgtaaacacacacaaactctcaagtggcctaattccctctcaccaaaccaatcacaatacagataaaagagaataacttgtgttcatttttgtacaaacaaaaaagatataaattgtgaatgatgcatgatttttaattacaagtaaactgggcaaatgcttctgcattatttaaagctaaaaggtgatcagtggaaactttcctctgttagtactctaatactttttatatttatcggctcactacaacctgtgcctaccaggttcaagcgattctcctgtctcagccacctgagtagccgagaccacaggcacgcactaccatgtccggctaattttgtatttttaatagagacagggtttcaccgtgttggccatgctggtcttgaactcctgacctcaaccgatccgcctgccttggcctcccaaagttctgggattacaagcgtgagccacagcgcccagccttattataattgttactatttaaatctcttttgctctctccttcaagagagacctcatcccattcagttgcttccatttatttattcatcttctgcctcctgggctcgagagatcctccagcgtgagtctcccaagtagctgggactacaggctcacaccaccaagcttggctaaattttgtaggttttggagagacaggctcttgccacgttgcctaggctggtctcaaactcctgggctcagatgatccacctgccttcgcctcccaaagcactgggacatgagccaccacgcccagccgcaagtacttttacacaaaatgcaaacaccattcttccatcataaaagtgataccacagcttccgtgaagttttgccaggtagtactcataattaccttgggtaaactttttgatgttaaactgtatcttcttattacgagtttt

SEQ ID NO: 436493 - DNA, 2175 bp, Homo sapiens
gggaatgaattggaagtaagcattatgatggtggtagaagcactatgtgaacttcattgtcctgaagctatacagggaattgctgtctggtcatcatctattgttggaaaacatcttctgtggattaactcagtggctcaacaggctgaagggaggtttgaaaaggcctctgtggagtaccaggaacacctgtgtgccatgacaggtgttgattgctgcatctccagctttgacaaatcggtgctcaccttagccagtgctgggtgtaagagtgccagcctgaaacattgtctgaatggtgaatccagaaaaagtgtgctgtccaaaccgactgactcttcccctgaggttataaattatttaggaaacaaagcatgtgagtgctacatctcaactgccgattgggctgctgtgcaggaatggcagaacgctatccatgacttgaaaaagagtaccagtagcacttccctcaacctgaaagctgacttcaactatataaaatcattaagcagctttgagtctggaaaatttgtcgaatgtaccgagcaattagaattgttaccaggagaaaatatcaatctacttgctggaggatcaaaagaaaaaatagacatgaaaaaactgcttcgtaacatgtgaagtccagatccaagggaacctcagaaatccattgaagttccattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcgtctgctttggagaccacagtttctaacagactttcaacagaggactgtcttattccactcttcggcgaagctttacgttcatgtaaacagcatgacgtgaggccgtggatgcaggcattaagggtatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatga

SEQ ID NO: 436494 - DNA, 2022 bp, Homo sapiens
gggaatgaattggaagtaagcattatgatggtggtagaagcactatgtgaacttcattgtcctgaagctatacagggaattgctgtctggtcatcatctattgttggaaaacatcttctgtggattaactcagtggctcaacaggctgaagggaggtttgaaaaggcctctgtggagtaccaggaacacctgtgtgccatgacaggtgttgattgctgcatctccagctttgacaaatcggtgctcaccttagccagtgctgggtgtaagagtgccagcctgaaacattgtctgaatggtgaatccagaaaaagtgtgctgtccaaaccgactgactcttcccctgaggttataaattatttaggaaacaaagcatgtgagtgctacatctcaactgccgattgggctgctgtgcaggaatggcagaacgctatccatgacttgaaaaagagtaccagtagcacttccctcaacctgaaagctgacttcaactatataaaatcattaagcagctttgagtctggaaaatttgtcgaatgtaccgagcaattagaattgttaccaggagaaaatatcaatctacttgctggaggatcaaaagaaaaaatagacatgaaaaaactgcttcgtaacatgtgaagtccagatccaagggaacctcagaaatccattgaagttccattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcgtctgctttggagaccacagtttctaacagactttcaacagaggactgtcttattccactcttcggcgaagctttacgttcatgtaaacagcatgacgtgaggccgtggatgcaggcattaagggtatgatctcgtgaaatcttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatga

SEQ ID NO: 436495 - DNA, 2120 bp, Homo sapiens
gggaatgaattggaagtaagcattatgatggtggtagaagcactatgtgaacttcattgtcctgaagctatacagggaattgctgtctggtcatcatctattgttggaaaacatcttctgtggattaactcagtggctcaacaggctgaagggaggtttgaaaaggcctctgtggagtaccaggaacacctgtgtgccatgacaggtgttgattgctgcatctccagctttgacaaatcggtgctcaccttagccagtgctgggtgtaagagtgccagcctgaaacattgtctgaatggtgaatccagaaaaagtgtgctgtccaaaccgactgactcttcccctgaggttataaattatttaggaaacaaagcatgtgagtgctacatctcaactgccgattgggctgctgtgcaggaatggcagaacgctatccatgacttgaaaaagagtaccagtagcacttccctcaacctgaaagctgacttcaactatataaaatcattaagcagctttgagtctggaaaatttgtcgaatgtaccgagcaattagaattgttaccaggagaaaatatcaatctacttgctggaggatcaaaagaaaaaatagacatgaaaaaactgcttcgtaacatgtgaagtccagatccaagggaacctcagaaatccattgaagttccattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcgtctgctttggagaccacagtttctaacagactttcaacagaggactgtcttattccactcttcggcgaagctttacgttcatgtaaacagcatgacgtgaggccgtggatgcaggcattaagggctggagtgcagtggcacgatctcagctcaccacagcctccgcctcccaggttcaagcgattctcctgcctcagcctcccgagtagctgggattacaggtatgatctcgtgaaatcttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatga

SEQ ID NO: 436496 - DNA, 555 bp, Homo sapiens
gtttgaaaaggcctctgtggagtaccaggaacacctgtgtgccatgacaggtgttgattgctgcatctccagctttgacaaatcggtgctcaccttagccagtgctgggtgtaagagtgccagcctgaaacattgtctgaatggtgagcgttcagcatttttaaataaagcaaaagttatagtaatatatttcgtactgatgatcttatcatgtttttaggtttctgtgctctttgaaatatttctaattgatctgaatctctctcttcttattttataaaatactttcaggtgaatccagaaaaagtgtgctgtccaaaccgactgactcttcccctgaggttataaattatttaggaaacaaagcatgtgagtgctacatctcaactgccgattgggctgctgtgcaggaatggcagaacgctatccatgacttgaaaaagagtaccagtagcacttccctcaacctgaaagctgacttcaactatataaagtaaggctttctgtttccagttataaaacaaatttccaataactatgatgtttttcctatgg

SEQ ID NO: 436497 - DNA, 2244 bp, Homo sapiens
gcatcgctagcacagttggtccgagctgccgaaaggtctggtcgcagagacaggaacgtgtaatcctcagcgtgctccagcccacagcttcgctctactgctcggcagggcagctggcctctgggcaccggcggcccctctgcctcgcggaaaagcctgatgaagtcctccgatattgatcaggatttattcacagacagttactgcaaggtgtgcagtgcacagctgatctccgaatcgcagcgtgtggcccactacgagagtcgaaaacatgcaagcaaagtccgactgtattacatgcttcaccccagggatggagggtgtcctgccaagaggctccggtcagaaaatggaagtgatgccgacatggtggataagaacaagtgctgcacactctgcaacatgtcattcacttcagcggtggtggccgattcccattatcaaggcaaaatccacgccaagaggttaaaactcttgctaggagagaagaccccattaaagaccacgtctgaggcgcaattacagatgtaccatctgcagtgtctccctaaactcaatagaacagtatcatgcccatctgaaaggatctaaacaccagaccaacctgaagaataagtagtgaaagcatcaatcaagacataagaacaaaacattagcatttctctgccgtggagaattgcttatcaaccaccagaggaggcttctttcttgaacaataaacatttcttataaggattcacagattcacatacgactgatcttgatttttggaaatgaatgaggtttcttttttctttttcctttttttaattttggggtaagttatgatatttggatggatttttaaattctttcctgataacatatttagcacatgttctaaattataatcctatagcaaacagttggagcattattcaaactgaaagtggaaaaatttaaatttccaatttattctagatttcctcagagcataattattctgttaaatcctcaatgagtgtgatgtaaaccacctctatccagaaatatacattcttttctcatcatgttggacacagttgagggtgacatgcacagaactggaacagatcactattagtggaaaataccaaatggacaaataaataccagtcgttttctccgttctccaagcacaggagccaggtttaccatctgaacaatgaagacgaagggagtaaataaaggaagaattctcatcttttttcctgatcattcaaagaacagtttctcaaggttaagccaagtcctccttgcaagttgccaaataatagcttaggaaaagaattagtctgcctgcatgatgatcttcttaggcaaaaacgtcttcacagcccttgaccttggtgaatttttttccccaaaagcatccaaaagaagaattataaaccccagaacgagatggaaataaacaagtattttttttttatgatgtttggcctgaactgtgggctttaattgggggatactgatcgtttggaaagaagtgagaaaattctgaagaaatggcggccttgggctaggcggggtcccctatttcttctgtttctcactgaagtcctactgctgagccaagactcagtcactctggaaagagcatgaccgataaagaaaacagttcctttctgatggggagcgtctgagtgcagatcatgaggctctttctctaggtttaattcttttccatggtgaccggacttggtgtcttgtagcctggttacgaagtgggacgttgagcttctactgacgatgccctgcatggaccagctgggatctggctggggctgccctgtgtccctaacgaccataggcaatccatcttcttgtgtcagcaatttctggacacccactgttttccaccaagagctgaggtggcaacaactcagtgagcaataaacaaaatgacacagaaatgcacagtgttgttatgaaggagcctgtttacctgtgttcaaaatctggcaccattcccttgagcagggcccgctcaggagggaccaggtctgccagtttctgtgcctgcagagagacgaagccccacgagccacaccctactctacaagaggaaagggggttggatgggaagaatctattttgctgttttggaaagcacacagccgacctacaaacctcctgtgatggtgtttcttcggatgtgtaaaataaggctttatttgtcaattccgctgtaaaataagcattgtccgagtaaaaacagcagca

SEQ ID NO: 436498 - DNA, 2377 bp, Homo sapiens
ggcatgcctttggaccgttcacaggctaattgggaaaagtggacaggcctgcctgaagcctgatgaagtcctccgatattgatcaggatttattcacagacagttactgcaaggtgtgcagtgcacagctgatctccgaatcgcagcgtgtggcccactacgagagtcgaaaacatgcaagcaaagtccgactgtattacatgcttcaccccagggatggagggtgtcctgccaagaggctccggtcagaaaatggaagtgatgccgacatggtggataagaacaagtgctgcacactctgcaacatgtcattcacttcagcggtggtggccgattcccattatcaaggcaaaatccacgccaagaggttaaaactcttgctaggagagaagaccccattaaagaccacagcaacacccctgagcccacttaagcccccacggatggacactgctccggtggtcgcatctccctatcaaagaagagattcagacagatactgtgggctctgtgcagcctggtttaataaccctctgatggcccagcaacattatgatggcaagaaacacaaaaagaatgcggcaagagttgctttgttagaacaactggggacaaccctggatatgggggaactgagaggtctgaggcgcaattacagatgtaccatctgcagtgtctccctaaactcaatagaacagtatcatgcccatctgaaaggatctaaacaccagaccaacctgaagaataagtagtgaaagcatcaatcaagacataagaacaaaacattagcatttctctgccgtggagaattgcttatcaaccaccagaggaggcttctttcttgaacaataaacatttcttataaggattcacagattcacatacgactgatcttgatttttggaaatgaatgaggtttcttttttctttttcctttttttaattttggggtaagttatgatatttggatggatttttaaattctttcctgataacatatttagcacatgttctaaattataatcctatagcaaacagttggagcattattcaaactgaaagtggaaaaatttaaatttccaatttattctagatttcctcagagcataattattctgttaaatcctcaatgagtgtgatgtaaaccacctctatccagaaatatacattcttttctcatcatgttggacacagttgagggtgacatgcacagaactggaacagatcactattagtggaaaataccaaatggacaaataaataccagtcgttttctccgttctccaagcacaggagccaggtttaccatctgaacaatgaagacgaagggagtaaataaaggaagaattctcatcttttttcctgatcattcaaagaacagtttctcaaggttaagccaagtcctccttgcaagttgccaaataatagcttaggaaaagaattagtctgcctgcatgatgatcttcttaggcaaaaacgtcttcacagcccttgaccttggtgaatttttttccccaaaagcatccaaaagaagaattataaaccccagaacgagatggaaataaacaagtattttttttttatgatgtttggcctgaactgtgggctttaattgggggatactgatcgtttggaaagaagtgagaaaattctgaagaaatggcggccttgggctaggcggggtcccctatttcttctgtttctcactgaagtcctactgctgagccaagactcagtcactctggaaagagcatgaccgataaagaaaacagttcctttctgatggggagcgtctgagtgcagatcatgaggctctttctctaggtttaattcttttccatggtgaccggacttggtgtcttgtagcctggttacgaagtgggacgttgagcttctactgacgatgccctgcatggaccagctgggatctggctggggctgccctgtgtccctaacgaccataggcaatccatcttcttgtgtcagcaatttctggacacccactgttttccaccaagagctgaggtggcaacaactcagtgagcaataaacaaaatgacacagaaatgcacagtgttgttatgaaggagcctgtttacctgtgttcaaaatctggcaccattcccttgagcagggcccgctcaggagggaccaggtctgccagtttctgtgcctgcagagagacgaagccccacgagccacaccctactctacaagaggaaagggggttggatgggaagaatctattttgctgttttggaaagcacacagccgacctacaaacctcctgtgatggtgtttcttcggatgtgtaaaataaggctttatttgtcaattccgctgtaaaataagcattgtccgagtaaaaacagcagca

SEQ ID NO: 436499 - DNA, 821 bp, Homo sapiens
gcatcgctagcacagttggtccgagctgccgaaaggtctggtcgcagagacaggaacgtgtaatcctcagcgtgctccagcccacagcttcgctctactgctcggcagggcagctggcctctgggcaccggcggcccctctgcctcgcggaaaagcctgatgaagtcctccgatattgatcaggatttattcacagacagttactgcaaggtgtgcagtgcacagctgatctccgaatcgcagcgtgtggcccactacgagtgtggtgcagttcctctgggaatgagcaatgtaacttaaaactagctgtgtcaataagtcaagggtccagaattcttgaggaaggggaatttcattagacatactaagccaaaagaagatgtcacactgaagaaggtggctgtgtgaattctgacccagtcgaaaacatgcaagcaaagtccgactgtattacatgcttcaccccagggatggagggtgtcctgccaagaggctccggtcagaaaatggaagtgatgccgacatggtggataagaacaagtgctgcacactctgcaacatgtcattcccttgagcagggcccgctcaggagggaccaggtctgccagtttctgtgcctgcagagagacgaagccccacgagccacaccctactctacaagaggaaagggggttggatgggaagaatctattttgctgttttggaaagcacacagccgacctacaaacctcctgtgatggtgtttcttcggatgtgtaaaataaggctttatttgtcaattccgctgtaaaataagcattgtccgagtaaaaacagcagca

SEQ ID NO: 436500 - DNA, 2474 bp, Homo sapiens
gcatcgctagcacagttggtccgagctgccgaaaggtctggtcgcagagacaggaacgtgtaatcctcagcgtgctccagcccacagcttcgctctactgctcggcagggcagctggcctctgggcaccggcggcccctctgcctcgcggaaaagcctgatgaagtcctccgatattgatcaggatttattcacagacagttactgcaaggtgtgcagtgcacagctgatctccgaatcgcagcgtgtggcccactacgagagtcgaaaacatgcaagcaaagtccgactgtattacatgcttcaccccagggatggagggtgtcctgccaagaggctccggtcagaaaatggaagtgatgccgacatggtggataagaacaagtgctgcacactctgcaacatgtcattcacttcagcggtggtggccgattcccattatcaaggcaaaatccacgccaagaggttaaaactcttgctaggagagaagaccccattaaagaccacagcaacacccctgagcccacttaagcccccacggatggacactgctccggtggtcgcatctccctatcaaagaagagattcagacagatactgtgggctctgtgcagcctggtttaataaccctctgatggcccagcaacattatgatggcaagaaacacaaaaagaatgcggcaagagttgctttgttagaacaactggggacaaccctggatatgggggaactgagaggtctgaggcgcaattacagatgtaccatctgcagtgtctccctaaactcaatagaacagtatcatgcccatctgaaaggatctaaacaccagaccaacctgaagaataagtagtgaaagcatcaatcaagacataagaacaaaacattagcatttctctgccgtggagaattgcttatcaaccaccagaggaggcttctttcttgaacaataaacatttcttataaggattcacagattcacatacgactgatcttgatttttggaaatgaatgaggtttcttttttctttttcctttttttaattttggggtaagttatgatatttggatggatttttaaattctttcctgataacatatttagcacatgttctaaattataatcctatagcaaacagttggagcattattcaaactgaaagtggaaaaatttaaatttccaatttattctagatttcctcagagcataattattctgttaaatcctcaatgagtgtgatgtaaaccacctctatccagaaatatacattcttttctcatcatgttggacacagttgagggtgacatgcacagaactggaacagatcactattagtggaaaataccaaatggacaaataaataccagtcgttttctccgttctccaagcacaggagccaggtttaccatctgaacaatgaagacgaagggagtaaataaaggaagaattctcatcttttttcctgatcattcaaagaacagtttctcaaggttaagccaagtcctccttgcaagttgccaaataatagcttaggaaaagaattagtctgcctgcatgatgatcttcttaggcaaaaacgtcttcacagcccttgaccttggtgaatttttttccccaaaagcatccaaaagaagaattataaaccccagaacgagatggaaataaacaagtattttttttttatgatgtttggcctgaactgtgggctttaattgggggatactgatcgtttggaaagaagtgagaaaattctgaagaaatggcggccttgggctaggcggggtcccctatttcttctgtttctcactgaagtcctactgctgagccaagactcagtcactctggaaagagcatgaccgataaagaaaacagttcctttctgatggggagcgtctgagtgcagatcatgaggctctttctctaggtttaattcttttccatggtgaccggacttggtgtcttgtagcctggttacgaagtgggacgttgagcttctactgacgatgccctgcatggaccagctgggatctggctggggctgccctgtgtccctaacgaccataggcaatccatcttcttgtgtcagcaatttctggacacccactgttttccaccaagagctgaggtggcaacaactcagtgagcaataaacaaaatgacacagaaatgcacagtgttgttatgaaggagcctgtttacctgtgttcaaaatctggcaccattcccttgagcagggcccgctcaggagggaccaggtctgccagtttctgtgcctgcagagagacgaagccccacgagccacaccctactctacaagaggaaagggggttggatgggaagaatctattttgctgttttggaaagcacacagccgacctacaaacctcctgtgatggtgtttcttcggatgtgtaaaataaggctttatttgtcaattccgctgtaaaataagcattgtccgagtaaaaacagcagca

SEQ ID NO: 436501 - DNA, 1107 bp, Homo sapiens
gcatcgctagcacagttggtccgagctgccgaaaggtctggtcgcagagacaggaacgtgtaatcctcagcgtgctccagcccacagcttcgctctactgctcggcagggcagctggcctctgggcaccggcggcccctctgcctcgcggaaaagcctgatgaagtcctccgatattgatcaggatttattcacagacagttactgcaaggtgtgcagtgcacagctgatctccgaatcgcagcgtgtggcccactacgagagtcgaaaacatgcaagcaaagtccgactgtattacatgcttcaccccagggatggagggtgtcctgccaagaggctccggtcagaaaatggaagtgatgccgacatggtggataagaacaagtgctgcacactctgcaacatgtcattcacttcagcggtggtggccgattcccattatcaaggcaaaatccacgccaagaggttaaaactcttgctaggagagaagaccccattaaagaccacagcaacacccctgagcccacttaagcccccacggatggacactgctccggtggtcgcatctccctatcaaagaagagattcagacagatactgtgggctctgtgcagcctggtttaataaccctctgatgccctgcatggaccagctgggatctggctggggctgccctgtgtccctaacgaccataggcaatccatcttcttgtgtcagcaatttctggacacccactgttttccaccaagagctgaggtggcaacaactcagtgagcaataaacaaaatgacacagaaatgcacagtgttgttatgaaggagcctgtttacctgtgttcaaaatctggcaccattcccttgagcagggcccgctcaggagggaccaggtctgccagtttctgtgcctgcagagagacgaagccccacgagccacaccctactctacaagaggaaagggggttggatgggaagaatctattttgctgttttggaaagcacacagccgacctacaaacctcctgtgatggtgtttcttcggatgtgtaaaataaggctttatttgtcaattccgctgtaaaataagcattgtccgagtaaaaacagcagca

SEQ ID NO: 436502 - DNA, 1476 bp, Homo sapiens
agtaaactgagttgatttgactttatctcagtactactcttgacctttcacaactttcgtaggttcacagtctctctttttctaggaacttggctgtgttgtcctgcctcagagacaaattcatctattgtaggcctagcccctgcctttgaaaacaaggaaaggttggtagaacatcaacacagcatggaatttccagggaggtctcatttcaaaacttcataaagaacaagaaccacctggacttctgtgagggcgatgattaaactggcctgagtttgaatgaaaggataatgtatgctcaacctgtgactaacaccaaggaggtcaagtggcagaaggtcttgtatgagcgacagccctttcctgataactatgtggaccggcgattcctggaagagctccggaaaaacatccatgctcggaaataccaatattgggctgtggtatttgagtccagtgtggtgatccagcagctgtgcagtgtttgtgtttttgtggttatctggtggtatatggatgagggtcttctggccccccattggcttttagggactggcctggcttcttcactgattgggtatgttttgtttgatctcattgatggaggtgaagggcggaagaagagtgggcagacccggtgggctgacctgaagagtgccctagtcttcattactttcacttatgggttttcaccagtgctgaagacccttacagagtctgtcagcactgacaccatctatgccatgtcagtcttcatgctgttaggccatctcatcttttttgactatggtgccaatgctgccattgtatccagcacactatccttgaacatggccatctttgcttctgtatgcttggcatcacgtcttccccggtccctgcatgccttcatcatggtgacatttgccattcagatttttgccctgtggcccatgttgcagaagaaactaaaggcatgtactccccggagctatgtgggggtcacactgctttttgcattttcagccgtgggaggcctactgtccattagtgctgtgggagccgtactctttgcccttctgctgatgtctatctcatgtctgtgtccattctacctcattcgcttgcagctttttaaagaaaacattcatgggccttgggatgaagctgaaatcaaggaagacttgtccaggttcctcagttaaattaggacatccattacattattaaagcaagctgatagattagcctcctaactagtatagaacttaaagacagagttccattctggaagcagcatgtcattgtggtaagagaatagagatcaaaaccaaaaaaaatgaaccaaaggcttgggtggtgagggtgcttatcctttctgttattttgtagatgaaaaaactttctggggacctcttgaattacatgctgtaacatatgaagtgatgtggtttctattaaaaaaataacacatccatcaagttgtctcatgat

SEQ ID NO: 436503 - DNA, 1669 bp, Homo sapiens
cccgggcccggaagtgcttggccacagtcgcagccccggcgccccgaagcgggaaaaaggctgggtgccgccgtcccccagctgcgcaaccctaggaactctcggatcaacctggatgccttccttcacaataatctcatggaggtaatttaaagaatcccttttttggagagtcagagagaaaagcaaaaaaaagagcatgaggaatttgaagactgagagatgagttgtgtagcaccaacattttctttctgcctgaccttcatacctgatgaattaaaagggcaataattaaggtggaatttgcctcacatgaagttttattattttagttattaaaatagtttccaacactactgagaagcaaaaagcaattctcgttgttttaagaacataggatgtttggaagagtgagataggggacacattgaaaacagagaggcaatctgaaggctaccttgacgcatctgcaaagctcccagattctgactttcacaagacttgctttctgtttctgggcctcgcctaaacagactgccagtcatccgaaccgtggcaggatggagatgtttgtgtaaggtagactcaagtttgcaagactcaagaaggaaaccaccaaactaattttactttcacttaaaccagattgaaaccaagacttgaagaattaaaaactttgacattaaccattgattcactccaatgaaataattgtgttatagccagaatcatggtgaaattggaacaaggcttttgatgggatttttaattgagggacttatattaaattggatattttctttaatgaacagcatgtggccaaaattctattttcattaaagtatattaagcatcatgacaactcatattaaacctgcaacaaatgattaatgacatttagagacttcaaatgtcatgagacaccttaaatattaagaatcaaaaagaacacctcaaagttgtttctattcttagtaattatgcttaaaaaaacatctttccttgctttgaaagccagttgctaaaaataaaaactgttccatgaaaaatcacaatgcccaatgataaatttatgtatttgttttttaaagggggaggatggtgagaaaaatagaaagctcctggctgacatcagaggtcacaagatgagttcctcatttgtccaaatgacattcagctgctaaaagaagtcagacttttagagggctgttgaaaagacagtaagtcaggaggttttcagtacatgactgcaggggaatcagacacaggctagtcacttaagttgcttaattgtccgtgtacccttagcccacgacttcagggctcagcagcttcatccttcatggcaccaaaccttgacgtaagggattcaaagacacactcataagaatcgtgaatttgtcctcatgcaaaatttgggggactggctacaaaaccgaaacaaggagatcgtatccctaagtgaaagggactttatattaattgtcagttataacaatatgtaaaatacataaaagagatagagcactgcaggccatcaaggtcaaacatttgaaacagaattaaactaaattataaggaggattaaatggcttttgtctttgtaaagaaaagaatatgcatgcattgattgcctatgtagaaggattaataaatcttttggcatggt

SEQ ID NO: 436504 - DNA, 1338 bp, Homo sapiens
caagccctagtatggcggcatgtacacaagttgagccggtgccgacatttcatctgatgagcataggatgtttggaagagtgagataggggacacattgaaaacagagaggcaatctgaaggctaccttgacgcatctgcaaagctcccagattctgactttcacaagacttgctttctgtttctgggcctcgcctaaacagactgccagtcatccgaaccgtggcaggatggagatgtttgtgtaaggtagactcaagtttgcaagactcaagaaggaaaccaccaaactaattttactttcacttaaaccagattgaaaccaagacttgaagaattaaaaactttgacattaaccattgattcactccaatgaaataattgtgttatagccagaatcatggtgaaattggaacaaggcttttgatgggatttttaattgagggacttatattaaattggatattttctttaatgaacagcatgtggccaaaattctattttcattaaagtatattaagcatcatgacaactcatattaaacctgcaacaaatgattaatgacatttagagacttcaaatgtcatgagacaccttaaatattaagaatcaaaaagaacacctcaaagttgtttctattcttagtaattatgcttaaaaaaacatctttccttgctttgaaagccagttgctaaaaataaaaactgttccatgaaaaatcacaatgcccaatgataaatttatgtatttgttttttaaagggggaggatggtgagaaaaatagaaagctcctggctgacatcagaggtcacaagatgagttcctcatttgtccaaatgacattcagctgctaaaagaagtcagacttttagagggctgttgaaaagacagtaagtcaggaggttttcagtacatgactgcaggggaatcagacacaggctagtcacttaagttgcttaattgtccgtgtacccttagcccacgacttcagggctcagcagcttcatccttcatggcaccaaaccttgacgtaagggattcaaagacacactcataagaatcgtgaatttgtcctcatgcaaaatttgggggactggctacaaaaccgaaacaaggagatcgtatccctaagtgaaagggactttatattaattgtcagttataacaatatgtaaaatacataaaagagatagagcactgcaggccatcaaggtcaaacatttgaaacagaattaaactaaattataaggaggattaaatggcttttgtctttgtaaagaaaagaatatgcatgcattgattgcctatgtagaaggattaataaatcttttggcatggt

SEQ ID NO: 436505 - DNA, 722 bp, Homo sapiens
ttcgcaccttatggcactcacccgcacactctcatcttccttttttttttagcagatcgcataccgagttttgctgccccttctaccaatgtctaagatgaacgggaaaaatgcatataaatggaatttttcttttacgtgatgatacagtgttttggtgtcccaaagaaataaaatccagcactgtccaattgaagtataatgcaagccacatttctagtagccatattttaaaaagtaacaataaagtgttgaaatttaccttaatactgccttttttaaccaaataggtccaaaatattattattttgacaggcattatgagttgagttgtgtcccccacaaaattcatgttgaagccctaaccagcagtaccacagaatgtgactatattgagagatggggttttaaaagaagtaattaagttaaaatggtttcattagggtgggccctaatccaatataactgatgttcttataacaagaggcaatatggacatgggcacacacagagggaagatcatgtgatgacatgagtcaagaagagaggcctcagaagaaaccaacctgacaacacctggatctcagacttctaccttctagaattgtgaaaaatacatttatcttgcttaacccacctagtctatgataatttgttatggcatctctagcaaactaatacaatatgtaatcaattaatgaaaataaaatgtattaataaga

SEQ ID NO: 436506 - DNA, 545 bp, Homo sapiens
atatagtgcagagcaaagcagcgtttgaactgatggcagcactaatgactctcggtgaaacagtgaaaagataaatgatccttaatcaggaaaatgtttaaataagcaagtgcctggatataccacagcaaaacaacctgaattcatttaagtaaatgaagaagaaaaaaagaagcagtaaactgccccttctaccaatgtctaagatgaacgggaaaaatgcatataaatggaatttttcttttacgattgcaataaggttctttgcagttgaagcactgaaatgacagctgtttatcattatcctcatcaaggaaatgtaaaataaaaatagtaatttgtctctgatctttgaggcaaaaaagaatggtctgcaaacatttaaccttttatgtgcaggttcaatgatgctgtttaaaaaacgtgaataatattgtagaaaccagcttgtttctaaaaaatacaatagacagtccttcctattgcagtttttaaaaatagctattgagaaatctaatttaaccaataaaaacaccagcattgta

SEQ ID NO: 436507 - DNA, 1464 bp, Homo sapiens
cggacgcgtgggtcgacccacgcgtccgctgggtgccgccgtcccccagctgcgcaaccctaggaactctcgggaacttggctgtgttgtcctgcctcagagacaaattcatctattgtaggcctagcccctgcctttgaaaacaaggaaaggttggtagaacatcaacacagcatggaatttccagggaggtctcatttcaaaacttcataaagaacaagaaccacctggacttctgtgagggcgatgattaaactggcctgagtttgaatgaaaggataatgtatgctcaacctgtgactaacaccaaggaggtcaagtggcagaaggtcttgtatgagcgacagccctttcctgataactatgtggaccggcgattcctggaagagctccggaaaaacatccatgctcggaaataccaatattgggctgtggtatttgagtccagtgtggtgatccagcagctgtgcagtgtttgtgtttttgtggttatctggtggtatatggatgagggtcttctggccccccattggcttttagggactggcctggcttcttcactgattgggtatgttttgtttgatctcattgatggaggtgaagggcggaagaagagtgggcagacccggtgggctgacctgaagagtgccctagtcttcattactttcacttatgggttttcaccagtgctgaagacccttacagagtctgtcagcactgacaccatctatgccatgtcagtcttcatgctgttaggccatctcatcttttttgactatggtgccaatgctgccattgtatccagcacactatccttgaacatggccatctttgcttctgtatgcttggcatcacgtcttccccggtccctgcatgccttcatcatggtgacatttgccattcagatttttgccctgtggcccatgttgcagaagaaactaaaggcatgtactccccggagctatgtgggggtcacactgctttttgcattttcagccgtgggaggcctactgtccattagtgctgtgggagccgtactctttgcccttctgctgatgtctatctcatgtctgtgtccattctacctcattcgcttgcagctttttaaagaaaacattcatgggccttgggatgaagctgaaatcaaggaagacttgtccaggttcctcagttaaattaggacatccattacattattaaagcaagctgatagattagcctcctaactagtatagaacttaaagacagagttccattctggaagcagcatgtcattgtggtaagagaatagagatcaaaaccaaaaaaaatgaaccaaaggcttgggtggtgagggtgcttatcctttctgttattttgtagatgaaaaaactttctggggacctcttgaattacatgctgtaacatatgaagtgatgtggtttctattaaaaaaataacacatccatcaagttgtctcatgat

SEQ ID NO: 436508 - DNA, 1780 bp, Homo sapiens
cccgggcccggaagtgcttggccacagtcgcagccccggcgccccgaagcgggaaaaaggctgggtgccgccgtcccccagctgcgcaaccctaggaactctcgggtaggtgggttccgtgtaacggtcagtgtttccggggctccttttcctctgctgcctcccgcagacccaaggctgagtgaggggcggcggcggaagtgggaggcccacccaaaaagccaaatggggtgccagaagagtgaaggcgcaccctggggtcaccctaccctaccccgtcccctcccagccccactctgcgggcgggcgctgcccttttgggcgtcgcagaccctccaacccggcggcggccttaagattcccgggctgggatccctgctgcagagggggaacttggctgtgttgtcctgcctcagagacaaattcatctattgtaggcctagcccctgcctttgaaaacaaggaaaggttggtagaacatcaacacagcatggaatttccagggaggtctcatttcaaaacttcataaagaacaagaaccacctggacttctgtgagggcgatgattaaactggcctgagtttgaatgaaaggataatgtatgctcaacctgtgactaacaccaaggaggtcaagtggcagaaggtcttgtatgagcgacagccctttcctgataactatgtggaccggcgattcctggaagagctccggaaaaacatccatgctcggaaataccaatattgggctgtggtatttgagtccagtgtggtgatccagcagctgtgcagtgtttgtgtttttgtggttatctggtggtatatggatgagggtcttctggccccccattggcttttagggactggcctggcttcttcactgattgggtatgttttgtttgatctcattgatggaggtgaagggcggaagaagagtgggcagacccggtgggctgacctgaagagtgccctagtcttcattactttcacttatgggttttcaccagtgctgaagacccttacagagtctgtcagcactgacaccatctatgccatgtcagtcttcatgctgttaggccatctcatcttttttgactatggtgccaatgctgccattgtatccagcacactatccttgaacatggccatctttgcttctgtatgcttggcatcacgtcttccccggtccctgcatgccttcatcatggtgacatttgccattcagatttttgccctgtggcccatgttgcagaagaaactaaaggcatgtactccccggagctatgtgggggtcacactgctttttgcattttcagccgtgggaggcctactgtccattagtgctgtgggagccgtactctttgcccttctgctgatgtctatctcatgtctgtgtccattctacctcattcgcttgcagctttttaaagaaaacattcatgggccttgggatgaagctgaaatcaaggaagacttgtccaggttcctcagttaaattaggacatccattacattattaaagcaagctgatagattagcctcctaactagtatagaacttaaagacagagttccattctggaagcagcatgtcattgtggtaagagaatagagatcaaaaccaaaaaaaatgaaccaaaggcttgggtggtgagggtgcttatcctttctgttattttgtagatgaaaaaactttctggggacctcttgaattacatgctgtaacatatgaagtgatgtggtttctattaaaaaaataacacatccatcaagttgtctcatgat

SEQ ID NO: 436509 - DNA, 1163 bp, Homo sapiens
  misc_feature (1142)..(1143): n is a, c, g, or t
  misc_feature (1145)..(1145): n is a, c, g, or t
  misc_feature (1155)..(1156): n is a, c, g, or t
cccgggcccggaagtgcttggccacagtcgcagccccggcgccccgaagcgggaaaaaggctgggtgccgccgtcccccagctgcgcaaccctaggaactctcgggaacttggctgtgttgtcctgcctcagagacaaattcatctattgtaggcctagcccctgcctttgaaaacaaggaaaggttggtagaacatcaacacagcatggaatttccagggaggtctcatttcaaaacttcataaagaacaagaaccacctggacttctgtgagggcgatgattaaactggcctgagtttgaatgaaaggataatgtatgctcaacctgtgactaacaccaaggaggtcaagtggcagaaggtcttgtatgagcgacagccctttcctgataactatgtggaccggcgattcctggaagagctccggaaaaacatccatgctcggaaataccaatattgggctgtggtatttgagtccagtgtggtgatccagcagctgtgcagtgtttgtgtttttgtggttatctggtggtatatggatgagggtcttctggccccccattggcttttagggactggcctggcttcttcactgattgggtatgttttgtttgatctcattgatggaggtgaagggcggaagaagagtgggcagacccggtgggctgacctgaagagtgccctagtcttcattactttcacttatgggttttcaccagtgctgaagacccttacagagtctgtcagcactgacaccatctatgccatgtcagtcttcatgctgttaggccatctcatcttttttgactatggtgccaatgctgccattgtatccagcacactatccttgaacatggccatctttgcttctgtatgcttggcatcacgtcttccccggtccctgcatgccttcatcatggtgacatttgccattcagatttttgccctgtggcccatgttgcagaagaaactaaaggcatgtactccccggagctatgtgggggtcacactgctttttgcattttcagccgtgggaggcctactgtccattagtgctgtgggagcggcacatgcgttgggagcggccatgcgttgggagcggccatgcgttgggagcgggggatcctctagagtcgggctgnngnaaaggggtcnncaaccaa

SEQ ID NO: 436510 - DNA, 1046 bp, Homo sapiens
cggacgcgtgggtcgacccacgcgtccgctgggtgccgccgtcccccagctgcgcaaccctaggaactctcggatcaacctggatgccttccttcacaataatctcatggaggtaatttaaagaatcccttttttggagagtcagagagaaaagcaaaaaaaagagcatgaggaatttgaagactgagagatgagttgtgtagcaccaacattttctttctgcctgaccttcatacctgatgaattaaaagaggctgagctggaatggcttcttcatcattaagggctgacctattggcttggcattgaaatcaatttagaacaaatggtctccatttcaagtcagcttgaaccatctaagccccagaacatgacacagaaaaaaagaagcagtaaactgccccttctaccaatgtctaagatgaacgggaaaaatgcatataaatggaatttttcttttacgtgatgatacagtgttttggtgtcccaaagaaataaaatccagcactgtccaattgaagtataatgcaagccacatttctagtagccatattttaaaaagtaacaataaagtgttgaaatttaccttaatactgccttttttaaccaaataggtccaaaatattattattttgacaggcattatgagttgagttgtgtcccccacaaaattcatgttgaagccctaaccagcagtaccacagaatgtgactatattgagagatggggttttaaaagaagtaattaagttaaaatggtttcattagggtgggccctaatccaatataactgatgttcttataacaagaggcaatatggacatgggcacacacagagggaagatcatgtgatgacatgagtcaagaagagaggcctcagaagaaaccaacctgacaacacctggatctcagacttctaccttctagaattgtgaaaaatacatttatcttgcttaacccacctagtctatgataatttgttatggcatctctagcaaactaatacaatatgtaatcaattaatgaaaataaaatgtattaataaga

SEQ ID NO: 436511 - DNA, 1447 bp, Homo sapiens
cggacgcgtgggtcgacccacgcgtccgctgggtgccgccgtcccccagctgcgcaaccctaggaactctcggcaaaaaaaagagcatgaggaatttgaagactgagagatgagttgtgtagcaccaacattttctttctgcctgaccttcatacctgatgaattaaaagcataggatgtttggaagagtgagataggggacacattgaaaacagagaggcaatctgaaggctaccttgacgcatctgcaaagctcccagattctgactttcacaagacttgctttctgtttctgggcctcgcctaaacagactgccagtcatccgaaccgtggcaggatggagatgtttgtgtaaggtagactcaagtttgcaagactcaagaaggaaaccaccaaactaattttactttcacttaaaccagattgaaaccaagacttgaagaattaaaaactttgacattaaccattgattcactccaatgaaataattgtgttatagccagaatcatggtgaaattggaacaaggcttttgatgggatttttaattgagggacttatattaaattggatattttctttaatgaacagcatgtggccaaaattctattttcattaaagtatattaagcatcatgacaactcatattaaacctgcaacaaatgattaatgacatttagagacttcaaatgtcatgagacaccttaaatattaagaatcaaaaagaacacctcaaagttgtttctattcttagtaattatgcttaaaaaaacatctttccttgctttgaaagccagttgctaaaaataaaaactgttccatgaaaaatcacaatgcccaatgataaatttatgtatttgttttttaaagggggaggatggtgagaaaaatagaaagctcctggctgacatcagaggtcacaagatgagttcctcatttgtccaaatgacattcagctgctaaaagaagtcagacttttagagggctgttgaaaagacagtaagtcaggaggttttcagtacatgactgcaggggaatcagacacaggctagtcacttaagttgcttaattgtccgtgtacccttagcccacgacttcagggctcagcagcttcatccttcatggcaccaaaccttgacgtaagggattcaaagacacactcataagaatcgtgaatttgtcctcatgcaaaatttgggggactggctacaaaaccgaaacaaggagatcgtatccctaagtgaaagggactttatattaattgtcagttataacaatatgtaaaatacataaaagagatagagcactgcaggccatcaaggtcaaacatttgaaacagaattaaactaaattataaggaggattaaatggcttttgtctttgtaaagaaaagaatatgcatgcattgattgcctatgtagaaggattaataaatcttttggcatggt

SEQ ID NO: 436512 - DNA, 1528 bp, Homo sapiens
cggacgcgtgggtcgacccacgcgtccgctgggtgccgccgtcccccagctgcgcaaccctaggaactctcggatcaacctggatgccttccttcacaataatctcatggaggtaatttaaagaatcccttttttggagagtcagagagaaaagcaaaaaaaagagcatgaggaatttgaagactgagagatgagttgtgtagcaccaacattttctttctgcctgaccttcatacctgatgaattaaaagcataggatgtttggaagagtgagataggggacacattgaaaacagagaggcaatctgaaggctaccttgacgcatctgcaaagctcccagattctgactttcacaagacttgctttctgtttctgggcctcgcctaaacagactgccagtcatccgaaccgtggcaggatggagatgtttgtgtaaggtagactcaagtttgcaagactcaagaaggaaaccaccaaactaattttactttcacttaaaccagattgaaaccaagacttgaagaattaaaaactttgacattaaccattgattcactccaatgaaataattgtgttatagccagaatcatggtgaaattggaacaaggcttttgatgggatttttaattgagggacttatattaaattggatattttctttaatgaacagcatgtggccaaaattctattttcattaaagtatattaagcatcatgacaactcatattaaacctgcaacaaatgattaatgacatttagagacttcaaatgtcatgagacaccttaaatattaagaatcaaaaagaacacctcaaagttgtttctattcttagtaattatgcttaaaaaaacatctttccttgctttgaaagccagttgctaaaaataaaaactgttccatgaaaaatcacaatgcccaatgataaatttatgtatttgttttttaaagggggaggatggtgagaaaaatagaaagctcctggctgacatcagaggtcacaagatgagttcctcatttgtccaaatgacattcagctgctaaaagaagtcagacttttagagggctgttgaaaagacagtaagtcaggaggttttcagtacatgactgcaggggaatcagacacaggctagtcacttaagttgcttaattgtccgtgtacccttagcccacgacttcagggctcagcagcttcatccttcatggcaccaaaccttgacgtaagggattcaaagacacactcataagaatcgtgaatttgtcctcatgcaaaatttgggggactggctacaaaaccgaaacaaggagatcgtatccctaagtgaaagggactttatattaattgtcagttataacaatatgtaaaatacataaaagagatagagcactgcaggccatcaaggtcaaacatttgaaacagaattaaactaaattataaggaggattaaatggcttttgtctttgtaaagaaaagaatatgcatgcattgattgcctatgtagaaggattaataaatcttttggcatggt

SEQ ID NO: 436513 - DNA, 1389 bp, Homo sapiens
cggacgcgtgggtcgacccacgcgtccgctgggtgccgccgtcccccagctgcgcaaccctaggaactctcggtttctttctgcctgaccttcatacctgatgaattaaaagcataggatgtttggaagagtgagataggggacacattgaaaacagagaggcaatctgaaggctaccttgacgcatctgcaaagctcccagattctgactttcacaagacttgctttctgtttctgggcctcgcctaaacagactgccagtcatccgaaccgtggcaggatggagatgtttgtgtaaggtagactcaagtttgcaagactcaagaaggaaaccaccaaactaattttactttcacttaaaccagattgaaaccaagacttgaagaattaaaaactttgacattaaccattgattcactccaatgaaataattgtgttatagccagaatcatggtgaaattggaacaaggcttttgatgggatttttaattgagggacttatattaaattggatattttctttaatgaacagcatgtggccaaaattctattttcattaaagtatattaagcatcatgacaactcatattaaacctgcaacaaatgattaatgacatttagagacttcaaatgtcatgagacaccttaaatattaagaatcaaaaagaacacctcaaagttgtttctattcttagtaattatgcttaaaaaaacatctttccttgctttgaaagccagttgctaaaaataaaaactgttccatgaaaaatcacaatgcccaatgataaatttatgtatttgttttttaaagggggaggatggtgagaaaaatagaaagctcctggctgacatcagaggtcacaagatgagttcctcatttgtccaaatgacattcagctgctaaaagaagtcagacttttagagggctgttgaaaagacagtaagtcaggaggttttcagtacatgactgcaggggaatcagacacaggctagtcacttaagttgcttaattgtccgtgtacccttagcccacgacttcagggctcagcagcttcatccttcatggcaccaaaccttgacgtaagggattcaaagacacactcataagaatcgtgaatttgtcctcatgcaaaatttgggggactggctacaaaaccgaaacaaggagatcgtatccctaagtgaaagggactttatattaattgtcagttataacaatatgtaaaatacataaaagagatagagcactgcaggccatcaaggtcaaacatttgaaacagaattaaactaaattataaggaggattaaatggcttttgtctttgtaaagaaaagaatatgcatgcattgattgcctatgtagaaggattaataaatcttttggcatggt

SEQ ID NO: 436514 - DNA, 1496 bp, Homo sapiens
cccgggcccggaagtgcttggccacagtcgcagccccggcgccccgaagcgggaaaaaggctgggtgccgccgtcccccagctgcgcaaccctaggaactctcgggaacttggctgtgttgtcctgcctcagagacaaattcatctattgtaggcctagcccctgcctttgaaaacaaggaaaggttggtagaacatcaacacagcatggaatttccagggaggtctcatttcaaaacttcataaagaacaagaaccacctggacttctgtgagggcgatgattaaactggcctgagtttgaatgaaaggataatgtatgctcaacctgtgactaacaccaaggaggtcaagtggcagaaggtcttgtatgagcgacagccctttcctgataactatgtggaccggcgattcctggaagagctccggaaaaacatccatgctcggaaataccaatattgggctgtggtatttgagtccagtgtggtgatccagcagctgtgcagtgtttgtgtttttgtggttatctggtggtatatggatgagggtcttctggccccccattggcttttagggactggcctggcttcttcactgattgggtatgttttgtttgatctcattgatggaggtgaagggcggaagaagagtgggcagacccggtgggctgacctgaagagtgccctagtcttcattactttcacttatgggttttcaccagtgctgaagacccttacagagtctgtcagcactgacaccatctatgccatgtcagtcttcatgctgttaggccatctcatcttttttgactatggtgccaatgctgccattgtatccagcacactatccttgaacatggccatctttgcttctgtatgcttggcatcacgtcttccccggtccctgcatgccttcatcatggtgacatttgccattcagatttttgccctgtggcccatgttgcagaagaaactaaaggcatgtactccccggagctatgtgggggtcacactgctttttgcattttcagccgtgggaggcctactgtccattagtgctgtgggagccgtactctttgcccttctgctgatgtctatctcatgtctgtgtccattctacctcattcgcttgcagctttttaaagaaaacattcatgggccttgggatgaagctgaaatcaaggaagacttgtccaggttcctcagttaaattaggacatccattacattattaaagcaagctgatagattagcctcctaactagtatagaacttaaagacagagttccattctggaagcagcatgtcattgtggtaagagaatagagatcaaaaccaaaaaaaatgaaccaaaggcttgggtggtgagggtgcttatcctttctgttattttgtagatgaaaaaactttctggggacctcttgaattacatgctgtaacatatgaagtgatgtggtttctattaaaaaaataacacatccatcaagttgtctcatgat

SEQ ID NO: 436515 - DNA, 1519 bp, Homo sapiens
cccgggcccggaagtgcttggccacagtcgcagccccggcgccccgaagcgggaaaaaggctgggtgccgccgtcccccagctgcgcaaccctaggaactctcgggttcacagtctctctttttctaggaacttggctgtgttgtcctgcctcagagacaaattcatctattgtaggcctagcccctgcctttgaaaacaaggaaaggttggtagaacatcaacacagcatggaatttccagggaggtctcatttcaaaacttcataaagaacaagaaccacctggacttctgtgagggcgatgattaaactggcctgagtttgaatgaaaggataatgtatgctcaacctgtgactaacaccaaggaggtcaagtggcagaaggtcttgtatgagcgacagccctttcctgataactatgtggaccggcgattcctggaagagctccggaaaaacatccatgctcggaaataccaatattgggctgtggtatttgagtccagtgtggtgatccagcagctgtgcagtgtttgtgtttttgtggttatctggtggtatatggatgagggtcttctggccccccattggcttttagggactggcctggcttcttcactgattgggtatgttttgtttgatctcattgatggaggtgaagggcggaagaagagtgggcagacccggtgggctgacctgaagagtgccctagtcttcattactttcacttatgggttttcaccagtgctgaagacccttacagagtctgtcagcactgacaccatctatgccatgtcagtcttcatgctgttaggccatctcatcttttttgactatggtgccaatgctgccattgtatccagcacactatccttgaacatggccatctttgcttctgtatgcttggcatcacgtcttccccggtccctgcatgccttcatcatggtgacatttgccattcagatttttgccctgtggcccatgttgcagaagaaactaaaggcatgtactccccggagctatgtgggggtcacactgctttttgcattttcagccgtgggaggcctactgtccattagtgctgtgggagccgtactctttgcccttctgctgatgtctatctcatgtctgtgtccattctacctcattcgcttgcagctttttaaagaaaacattcatgggccttgggatgaagctgaaatcaaggaagacttgtccaggttcctcagttaaattaggacatccattacattattaaagcaagctgatagattagcctcctaactagtatagaacttaaagacagagttccattctggaagcagcatgtcattgtggtaagagaatagagatcaaaaccaaaaaaaatgaaccaaaggcttgggtggtgagggtgcttatcctttctgttattttgtagatgaaaaaactttctggggacctcttgaattacatgctgtaacatatgaagtgatgtggtttctattaaaaaaataacacatccatcaagttgtctcatgat

SEQ ID NO: 436516 - DNA, 945 bp, Homo sapiens
cccgggcccggaagtgcttggccacagtcgcagccccggcgccccgaagcgggaaaaaggctgggtgccgccgtcccccagctgcgcaaccctaggaactctcgggaacttggctgtgttgtcctgcctcagagacaaattcatctattgtaggcctagcccctgcctttgaaaacaaggaaaggttggtagaacatcaacacagcatggaatttccagggaggtctcatttcaaaacttcataaagaacaagaaccacctggacttctgtgagggcgatgattaaactggcctgagtttgaatgaaaggataatgtatgctcaacctgtgactaacaccaaggaggtcaagtggcagaaggtcttgtatgagcgacagccctttcctgataactatgtggaccggcgattcctggaagagctccggaaaaacatccatgctcggaaataccaatattgggctgtggtatttgagtccagtgtggtgatccagcagctgtgcagtgtttgtgtttttgtggttatctggtggtatatggatgagggtcttctggccccccattggcttttagggactggcctggcttcttcactgattgggtatgttttgtttgatctcattgatggaggtgaagggcggaagaagagtgggcagacccggtgggctgacctgaagagtgccctagtcttcattactttcacttatgggttttcaccagtgctgaagacccttacagagtctgtcagcactgacaccatctatgccatgtcagtcttcatgctgttaggccatctcatcttttttgactatggtgccaatgctgccattgtatccagcacactatcctttcattcaaactcaggccagtttaatcatcgccctcacagaagtccaggtggttcttgttctttatgaacgttttgaaattgagacctccctgggaa

SEQ ID NO: 436517 - DNA, 1670 bp, Homo sapiens
ggttggggggacatgccacatgcctctggccccaccatctcatgcctttgccatccatctcctgactggccagaaggacaccaggagcagctcatgagctacaaaaactgaaggtcgggaacccaaggtcgtgcaccaaaggtcatgagaattttgcattttatgttgctctcatttctgatcatttgaaacaacctctctgagtttctgaaagggaagggaatggagaaaagcacacccaattatgctaggttctgttttattttggcttttgtttttgttttttttcccacccaccacaagttcttttcttcccctctcatagtgtgggcgaaatgctgaaaacttcgaccgatttttcacccgccatccaccagtcctaacacctcccgaccaggaagtcatcaggaatattgaccaatcagaattcgaaggattttcctttgttaactctgaatttttaaaacccgaagtcaagagctaagtagatgtgtagatctccgtccttcatttctgtcattcaagctcaacggctattgtggtgacatttttatgtttttcattgccaagttgcatccatgtttgattttctgatgagactagagtgacagtgtttcagaacccaaatgtcctcaggtagtttggagcatctctatgagatgggattatgcagatggcctatggaaaatgcagctgcataattaacacattatcaaagtcctcttacaatttattttccgcagcatgtcagctaagtagacccaatggggagagaaaatgcctgctttctttccctctttttctgcactgccatattcacccccaaccatccaatctgtggataattggatgttagcggtactcttccacttccgggcctggagcttggcttgtatccaagtgtatggttgctttgcctaagaggaatccctctatttcacctgttctggaggcaccagaccttgaaaagaacatgctcaaaataaaatgttatctgttatttttgtaaactcaaagttaagatgatcaaagttctaaaattccaagaatgtgcttttagacggtctcaatctaaaagcacttcaaggggtcaaagggcaaccagcttgggtgctacctcagtgttgtagtttctgatactttatgtctttgctcaccctcatccccaaactacttgaaaagggcatttggcaccactctctgaaacaacacagtcactctagcaaggcccccaaagggccctggttttacattacatttcaaactttatttgctttggggttttgtttctgttgttgttcaaatgcaaaaaaaagaaaaaaaaagaaaaaaaaaggtgactcacattgttacacatgctttaaaatatgtattcaaatgttattaaccacaatgacgacctgctttgatttaaccaagaagacggctgcggagcctagcagactcaggcctgtgggaatgggatttgttacaaatctaggtttgttactggcttcagaaagctaattaagtgctctgaaaaagacaccgtttcttgaaacaaagatggttgtattcctcactttgatgttgttttgcaagatgtttgtggaaatgttcatttgtatctggatctctgttatgtgccatttttcttctagcatcgagatacaataaaaaaaaaaaaaaag

SEQ ID NO: 436518 - DNA, 3387 bp, Homo sapiens
agctgggcgagtgacagccccggctccgcgcgccgcggccgccagagccggcgcaggggaagcgcccggggccccgggtgcagcagcggccgccgcctcccgcgcctccccggcccgcagcccgcggtcccgcggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctggggcttcgggaagcagggattccagtgccaagtttgctgctttgtggtgcacaagcggtgccatgaatttgtcacattctcctgccctggcgctgacaagggtccagcctccgatgacccccgcagcaaacacaagtttaagatccacacgtactccagccccacgttttgtgaccactgtgggtcactgctgtatggactcatccaccaggggatgaaatgtgacacctgcatgatgaatgtgcacaagcgctgcgtgatgaatgttcccagcctgtgtggcacggaccacacggagcgccgcggccgcatctacatccaggcccacatcgacagggacgtcctcattgtcctcgtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagatttcagctgaaagaatcggacaaagacagaagactgtcagtagagatttgggattgggatttgaccagcaggaatgacttcatgggatctttgtcctttgggatttctgaacttcagaaagccagtgttgatggctggtttaagttactgagccaggaggaaggcgagtacttcaatgtgcctgtgccaccagaaggaagtgaggccaatgaagaactgcggcagaaatttgagagggccaagatcagtcagggaaccaaggtcccggaagaaaagacgaccaacactgtctccaaatttgacaacaatggcaacagagaccggatgaaactgaccgattttaacttcctaatggtgctggggaaaggcagctttggcaaggtcatgctttcagaacgaaaaggcacagatgagctctatgctgtgaagatcctgaagaaggacgttgtgatccaagatgatgacgtggagtgcactatggtggagaagcgggtgttggccctgcctgggaagccgcccttcctgacccagctccactcctgcttccagaccatggaccgcctgtactttgtgatggagtacgtgaatgggggcgacctcatgtatcacatccagcaagtcggccggttcaaggagccccatgctgtattttacgctgcagaaattgccatcggtctgttcttcttacagagtaagggcatcatttaccgtgacctaaaacttgacaacgtgatgctcgattctgagggacacatcaagattgccgattttggcatgtgtaaggaaaacatctgggatggggtgacaaccaagacattctgtggcactccagactacatcgcccccgagataattgcttatcagccctatgggaagtccgtggattggtgggcatttggagtcctgctgtatgaaatgttggctgggcaggcaccctttgaaggggaggatgaagatgaactcttccaatccatcatggaacacaacgtagcctatcccaagtctatgtccaaggaagctgtggccatctgcaaagggctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagcttgtgggcgaaatgctgaaaacttcgaccgatttttcacccgccatccaccagtcctaacacctcccgaccaggaagtcatcaggaatattgaccaatcagaattcgaaggattttcctttgttaactctgaatttttaaaacccgaagtcaagagctaagtagatgtgtagatctccgtccttcatttctgtcattcaagctcaacggctattgtggtgacatttttatgtttttcattgccaagttgcatccatgtttgattttctgatgagactagagtgacagtgtttcagaacccaaatgtcctcaggtagtttggagcatctctatgagatgggattatgcagatggcctatggaaaatgcagctgcataattaacacattatcaaagtcctcttacaatttattttccgcagcatgtcagctaagtagacccaatggggagagaaaatgcctgctttctttccctctttttctgcactgccatattcacccccaaccatccaatctgtggataattggatgttagcggtactcttccacttccgggcctggagcttggcttgtatccaagtgtatggttgctttgcctaagaggaatccctctatttcacctgttctggaggcaccagaccttgaaaagaacatgctcaaaataaaatgttatctgttatttttgtaaactcaaagttaagatgatcaaagttctaaaattccaagaatgtgcttttagacggtctcaatctaaaagcacttcaaggggtcaaagggcaaccagcttgggtgctacctcagtgttgtagtttctgatactttatgtctttgctcaccctcatccccaaactacttgaaaagggcatttggcaccactctctgaaacaacacagtcactctagcaaggcccccaaagggccctggttttacattacatttcaaactttatttgctttggggttttgtttctgttgttgttcaaatgcaaaaaaaagaaaaaaaaagaaaaaaaaaggtgactcacattgttacacatgctttaaaatatgtattcaaatgttattaaccacaatgacgacctgctttgatttaaccaagaagacggctgcggagcctagcagactcaggcctgtgggaatgggatttgttacaaatctaggtttgttactggcttcagaaagctaattaagtgctctgaaaaagacaccgtttcttgaaacaaagatggttgtattcctcactttgatgttgttttgcaagatgtttgtggaaatgttcatttgtatctggatctctgttatgtgccatttttcttctagcatcgagatacaataaaaaaaaaaaaaaag

SEQ ID NO: 436519 - DNA, 3071 bp, Homo sapiens
agctgggcgagtgacagccccggctccgcgcgccgcggccgccagagccggcgcaggggaagcgcccggggccccgggtgcagcagcggccgccgcctcccgcgcctccccggcccgcagcccgcggtcccgcggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctggggcttcgggaagcagggattccagtgccaagtttgctgctttgtggtgcacaagcggtgccatgaatttgtcacattctcctgccctggcgctgacaagggtccagcctccgatgacccccgcagcaaacacaagtttaagatccacacgtactccagccccacgttttgtgaccactgtgggtcactgctgtatggactcatccaccaggggatgaaatgtgacacctgcatgatgaatgtgcacaagcgctgcgtgatgaatgttcccagcctgtgtggcacggaccacacggagcgccgcggccgcatctacatccaggcccacatcgacagggacgtcctcattgtcctcgtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagatttcagctgaaagaatcggacaaagacagaagactgtcagtagagatttgggattgggatttgaccagcaggaatgacttcatgggatctttgtcctttgggatttctgaacttcagaaagccagtgttgatggctggtttaagttactgagccaggaggaaggcgagtacttcaatgtgcctgtgccaccagaaggaagtgaggccaatgaagaactgcggcagaaatttgagagggccaagatcagtcagggaaccaaggtcccggaagaaaagacgaccaacactgtctccaaatttgacaacaatggcaacagagaccggatgaaactgaccgattttaacttcctaatggtgctggggaaaggcagctttggcaaggtcatgctttcagaacgaaaaggcacagatgagctctatgctgtgaagatcctgaagaaggacgttgtgatccaagatgatgacgtggagtgcactatggtggagaagcgggtgttggccctgcctgggaagccgcccttcctgacccagctccactcctgcttccagaccatggaccgcctgtactttgtgatggagtacgtgaatgggggcgacctcatgtatcacatccagcaagtcggccggttcaaggagccccatgctgtattttacgctgcagaaattgccatcggtctgttcttcttacagagtaagggcatcatttaccgtgacctaaaacttgacaacgtgatgctcgattctgagggacacatcaagattgccgattttggcatgtgtaaggaaaacatctgggatggggtgacaaccaagacattctgtggcactccagactacatcgcccccgagataattgcttatcagccctatgggaagtccgtggattggtgggcatttggagtcctgctgtatgaaatgttggctgggcaggcaccctttgaaggggaggatgaagatgaactcttccaatccatcatggaacacaacgtagcctatcccaagtctatgtccaaggaagctgtggccatctgcaaagggctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagcttgtgggcgaaatgctgaaaacttcgaccgatttttcacccgccatccaccagtcctaacacctcccgaccaggaagtcatcaggaatattgaccaatcagaattcgaaggattttcctttgttaactctgaatttttaaaacccgaagtcaagagctaagtagatgtgtagatctccgtccttcatttctgtcattcaagctcaacggctattgtggtgacatttttatgtttttcattgccaagttgcatccatgtttgattttctgatgagactagagtgacagtgtttcagaacccaaatgtcctcaggtagtttggagcatctctatgagatgggattatgcagatggcctatggaaaatgcagctgcataattaacacattatcaaagtcctcttacaatttattttccgcagcatgtcagctaagtagacccaatggggagagaaaatgcctgctttctttccctctttttctgcactgccatattcacccccaaccatccaatctgtggataattggatgttagcggtactcttccacttccgggcctggagcttggcttgtatccaagtgtatggttgctttgcctaagaggaatccctctatttcacctgttctggaggcaccagaccttgaaaagaacatgctcaaaataaaatgttatctgttatttttgtaaactcaaagttaagatgatcaaagttctaaaattccaagaatgtgcttttagacggtctcaatctaaaagcacttcaaggggtcaaagggcaaccagcttgggtgctacctcagtgttgtagtttctgatactttatgtctttgctcaccctcatccccaaactacttgaaaagggcatttggcaccactctctgaaacaacacagtcactctagcaaggcccccaaagggccctggttttacattacatttcaaactttatttgctttggggttttgtttctgttgttgttcaaatgcaaaaaaaaattatttgctttggggttttatttctgttgttcaaatgc

SEQ ID NO: 436520 - DNA, 565 bp, Homo sapiens
agctgggcgagtgacagccccggctccgcgcgccgcggccgccagagccggcgcaggggaagcgcccggggccccgggtgcagcagcggccgccgcctcccgcgcctccccggcccgcagcccgcggtcccgcggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctgaagggacacactttccttcccactgatgtggagcattggccaatggaacgtgagcagacacaatctactctacatttaaacagaggctttgagaagctattgtgtggtttagccattgttcttcccacctctgccacaagaccaagaaagggctgttgcctcagctgcgtcctgggatggaaaagacacaggaagtagaatcacagagccaca

SEQ ID NO: 436521 - DNA, 3086 bp, Homo sapiens
agcaccgtttctgggcacagggctccagcgatggtcccaacaggtacaatgacctctggggaccaagttcagttcttggtgagttctccagtgcctctcgatgtaggatgaaccgttggcatgctccactgacgctggctccttctgttgtttctcttggctccaggacccccgcagcaaacacaagtttaagatccacacgtactccagccccacgttttgtgaccactgtgggtcactgctgtatggactcatccaccaggggatgaaatgtgacacctgcatgatgaatgtgcacaagcgctgcgtgatgaatgttcccagcctgtgtggcacggaccacacggagcgccgcggccgcatctacatccaggcccacatcgacagggacgtcctcattgtcctcgtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagatttcagctgaaagaatcggacaaagacagaagactgtcagtagagatttgggattgggatttgaccagcaggaatgacttcatgggatctttgtcctttgggatttctgaacttcagaaagccagtgttgatggctggtttaagttactgagccaggaggaaggcgagtacttcaatgtgcctgtgccaccagaaggaagtgaggccaatgaagaactgcggcagaaatttgagagggccaagatcagtcagggaaccaaggtcccggaagaaaagacgaccaacactgtctccaaatttgacaacaatggcaacagagaccggatgaaactgaccgattttaacttcctaatggtgctggggaaaggcagctttggcaaggtcatgctttcagaacgaaaaggcacagatgagctctatgctgtgaagatcctgaagaaggacgttgtgatccaagatgatgacgtggagtgcactatggtggagaagcgggtgttggccctgcctgggaagccgcccttcctgacccagctccactcctgcttccagaccatggaccgcctgtactttgtgatggagtacgtgaatgggggcgacctcatgtatcacatccagcaagtcggccggttcaaggagccccatgctgtattttacgctgcagaaattgccatcggtctgttcttcttacagagtaagggcatcatttaccgtgacctaaaacttgacaacgtgatgctcgattctgagggacacatcaagattgccgattttggcatgtgtaaggaaaacatctgggatggggtgacaaccaagacattctgtggcactccagactacatcgcccccgagataattgcttatcagccctatgggaagtccgtggattggtgggcatttggagtcctgctgtatgaaatgttggctgggcaggcaccctttgaaggggaggatgaagatgaactcttccaatccatcatggaacacaacgtagcctatcccaagtctatgtccaaggaagctgtggccatctgcaaagggctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagcttgtgggcgaaatgctgaaaacttcgaccgatttttcacccgccatccaccagtcctaacacctcccgaccaggaagtcatcaggaatattgaccaatcagaattcgaaggattttcctttgttaactctgaatttttaaaacccgaagtcaagagctaagtagatgtgtagatctccgtccttcatttctgtcattcaagctcaacggctattgtggtgacatttttatgtttttcattgccaagttgcatccatgtttgattttctgatgagactagagtgacagtgtttcagaacccaaatgtcctcaggtagtttggagcatctctatgagatgggattatgcagatggcctatggaaaatgcagctgcataattaacacattatcaaagtcctcttacaatttattttccgcagcatgtcagctaagtagacccaatggggagagaaaatgcctgctttctttccctctttttctgcactgccatattcacccccaaccatccaatctgtggataattggatgttagcggtactcttccacttccgggcctggagcttggcttgtatccaagtgtatggttgctttgcctaagaggaatccctctatttcacctgttctggaggcaccagaccttgaaaagaacatgctcaaaataaaatgttatctgttatttttgtaaactcaaagttaagatgatcaaagttctaaaattccaagaatgtgcttttagacggtctcaatctaaaagcacttcaaggggtcaaagggcaaccagcttgggtgctacctcagtgttgtagtttctgatactttatgtctttgctcaccctcatccccaaactacttgaaaagggcatttggcaccactctctgaaacaacacagtcactctagcaaggcccccaaagggccctggttttacattacatttcaaactttatttgctttggggttttgtttctgttgttgttcaaatgcaaaaaaaagaaaaaaaaagaaaaaaaaaggtgactcacattgttacacatgctttaaaatatgtattcaaatgttattaaccacaatgacgacctgctttgatttaaccaagaagacggctgcggagcctagcagactcaggcctgtgggaatgggatttgttacaaatctaggtttgttactggcttcagaaagctaattaagtgctctgaaaaagacaccgtttcttgaaacaaagatggttgtattcctcactttgatgttgttttgcaagatgtttgtggaaatgttcatttgtatctggatctctgttatgtgccatttttcttctagcatcgagatacaataaaaaaaaaaaaaaag

SEQ ID NO: 436522 - DNA, 2090 bp, Homo sapiens
caggggcgagctgcactaactcaggggcgagctgctaactcaggggcgagctgctatctcaggggagcagccacaaagaagcaagtcttgtaaaaggtcttttgcaaaggagagtgaacccagcaatgagagatccttaacagctagtgcccattagggggctaaacctaaagcctgggtggtgatggctcaaacgctaatgagtcagtgaatccttaccgaccccctggcctttataatctgaggcaactttggctgcagcccgggaatgtgcagggcactagggaatacaaggccttcttccctggttgtcttgtaataaaacagccatggggttgtccctccagtccgagagactgagatgaggcctacatagcagcgatgtggtcaggtaaaaatcaggaacccactgaaatcttgggcaagccaccctgcctgcttgtgcctcggttctctcatatgtcatatataggaggtgaggactccagctccacctgccccaggtgggtgtggtgatgatgaggaaagacaagaggcttgcaaggaccctgaagaggtcggagcatcatacagattcctttattagcccacattctgatgttccctggtgagacttgccccaagcaattgctagtaaatgggggttaatttcttctccacctccctactgaacaaaaaaagaaatgccagacttactaggagaatcgagttgctttgagtttcttttgttttgttttgttttgttttgttttaaggctccccttacacaccctcctttaagctttgggttttctctcttatagtttgttgacacatgctaaaaatgtctttggagagaacttctgcctgataaacacccaattctagactgtgggtggattttcgagctgacggtggtcaattcctttcattaagcagtgatctgatttctccacatggccattctgccttcttgggggcagagtagatgggcagcagttcaccttttcagagaaagaggtcttctagccacctgggctgctactgaatggttttctccaggacgctctacctaatgattatttctataacattaagcatggtaataagtagcttccaattcaattcatcctaaagccaaagaaaatacagcaacacacacacaacacacacacacacacacacacacacacacacacacaccactttatggcaattcttaactgacattcaatgacttacttcttttcttagaaaatttccaccacatttctatccccaagccaacatacaatgtgaaatgaaagccagtgcgtggagtgcagctgctaaaaattttcagcacagggctctttctgactctgctcatgagatggtatcagccacccaatgactggcgtatcttggtcctgtgtctttcttcttacgctgtgttaatgtgtttactttccatttggcagagagacaagagagacacctccaacttcgacaaagagttcaccagacagcctgtggaactgacccccactgataaactcttcatcatgaacttggaccaaaatgaatttgctggcttctcttatactaacccagagtttgtcattaatgtgtaggtgaatgcaaactccatcgttgagcctggggtgtaagacttcaagccaagcgtatgtatcaattctagtcttccaggattcacggtgcacatgctggcattcaacatgtggaaagcttgtcttagagggcttttctttgtatgtgtagcttgctagtttgttttctacatttgaaaatgtttagtttagaataagcgcattatccaattatagaggtacaattttccaaacttccagaaactcatcaaatgaacagacaatgtcaaaactactgtgtctgataccaaaatgcttcagtatttgtaatttttcaagtcagaagctgatgttcctggtaaaagtttttacagttattctataatatcttctttgaatgctaagcatgagcgatatttttaaaaattgtgagtaagctttgcagttactgtgaactattgtctcttggaggaagttttttgtttaagaattgatatgattaaactgaattaatatatgcaa

SEQ ID NO: 436523 - DNA, 2036 bp, Homo sapiens
caggggcgagctgcactaactcaggggcgagctgctaactcaggggcgagctgctatctcaggggagcagccacaaagaagcaagtcttgtaaaaggtcttttgcaaaggagagtgaacccagcaatgagagatccttaacagctagtgcccattagggggctaaacctaaagcctgggtggtgatggctcaaacgctaatgagtcagtgaatccttaccgaccccctggcctttataatctgaggcaactttggctgcagcccgggaatgtgcagggcactagggaatacaaggccttcttccctggttgtcttgtaataaaacagccatggggttgtccctccagtccgagagactgagatgaggcctacatagcagcgatgtggtcagctcggttctctcatatgtcatatataggaggtgaggactccagctccacctgccccaggtgggtgtggtgatgatgaggaaagacaagaggcttgcaaggaccctgaagaggtcggagcatcatacagattcctttattagcccacattctgatgttccctggtgagacttgccccaagcaattgctagtaaatgggggttaatttcttctccacctccctactgaacaaaaaaagaaatgccagacttactaggagaatcgagttgctttgagtttcttttgttttgttttgttttgttttgttttaaggctccccttacacaccctcctttaagctttgggttttctctcttatagtttgttgacacatgctaaaaatgtctttggagagaacttctgcctgataaacacccaattctagactgtgggtggattttcgagctgacggtggtcaattcctttcattaagcagtgatctgatttctccacatggccattctgccttcttgggggcagagtagatgggcagcagttcaccttttcagagaaagaggtcttctagccacctgggctgctactgaatggttttctccaggacgctctacctaatgattatttctataacattaagcatggtaataagtagcttccaattcaattcatcctaaagccaaagaaaatacagcaacacacacacaacacacacacacacacacacacacacacacacacacaccactttatggcaattcttaactgacattcaatgacttacttcttttcttagaaaatttccaccacatttctatccccaagccaacatacaatgtgaaatgaaagccagtgcgtggagtgcagctgctaaaaattttcagcacagggctctttctgactctgctcatgagatggtatcagccacccaatgactggcgtatcttggtcctgtgtctttcttcttacgctgtgttaatgtgtttactttccatttggcagagagacaagagagacacctccaacttcgacaaagagttcaccagacagcctgtggaactgacccccactgataaactcttcatcatgaacttggaccaaaatgaatttgctggcttctcttatactaacccagagtttgtcattaatgtgtaggtgaatgcaaactccatcgttgagcctggggtgtaagacttcaagccaagcgtatgtatcaattctagtcttccaggattcacggtgcacatgctggcattcaacatgtggaaagcttgtcttagagggcttttctttgtatgtgtagcttgctagtttgttttctacatttgaaaatgtttagtttagaataagcgcattatccaattatagaggtacaattttccaaacttccagaaactcatcaaatgaacagacaatgtcaaaactactgtgtctgataccaaaatgcttcagtatttgtaatttttcaagtcagaagctgatgttcctggtaaaagtttttacagttattctataatatcttctttgaatgctaagcatgagcgatatttttaaaaattgtgagtaagctttgcagttactgtgaactattgtctcttggaggaagttttttgtttaagaattgatatgattaaactgaattaatatatgcaa

SEQ ID NO: 436524 - DNA, 2400 bp, Homo sapiens
agctgggcgagtgacagccccggctccgcgcgccgcggccgccagagccggcgcaggggaagcgcccggggccccgggtgcagcagcggccgccgcctcccgcgcctccccggcccgcagcccgcggtcccgcggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctggggcttcgggaagcagggattccagtgccaagtttgctgctttgtggtgcacaagcggtgccatgaatttgtcacattctcctgccctggcgctgacaagggtccagcctccgatgacccccgcagcaaacacaagtttaagatccacacgtactccagccccacgttttgtgaccactgtgggtcactgctgtatggactcatccaccaggggatgaaatgtgacacctgcatgatgaatgtgcacaagcgctgcgtgatgaatgttcccagcctgtgtggcacggaccacacggagcgccgcggccgcatctacatccaggcccacatcgacagggacgtcctcattgtcctcgtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagatttcagctgaaagaatcggacaaagacagaagactgtcagtagagatttgggattgggatttgaccagcaggaatgacttcatgggatctttgtcctttgggatttctgaacttcagaaagccagtgttgatggctggtttaagttactgagccaggaggaaggcgagtacttcaatgtgcctgtgccaccagaaggaagtgaggccaatgaagaactgcggcagaaatttgagagggccaagatcagtcagggaaccaaggtcccggaagaaaagacgaccaacactgtctccaaatttgacaacaatggcaacagagaccggatgaaactgaccgattttaacttcctaatggtgctggggaaaggcagctttggcaaggtcatgctttcagaacgaaaaggcacagatgagctctatgctgtgaagatcctgaagaaggacgttgtgatccaagatgatgacgtggagtgcactatggtggagaagcgggtgttggccctgcctgggaagccgcccttcctgacccagctccactcctgcttccagaccatggaccgcctgtactttgtgatggagtacgtgaatgggggcgacctcatgtatcacatccagcaagtcggccggttcaaggagccccatgctgtattttacgctgcagaaattgccatcggtctgttcttcttacagagtaagggcatcatttaccgtgacctaaaacttgacaacgtgatgctcgattctgagggacacatcaagattgccgattttggcatgtgtaaggaaaacatctgggatggggtgacaaccaagacattctgtggcactccagactacatcgcccccgagataattgcttatcagccctatgggaagtccgtggattggtgggcatttggagtcctgctgtatgaaatgttggctgggcaggcaccctttgaaggggaggatgaagatgaactcttccaatccatcatggaacacaacgtagcctatcccaagtctatgtccaaggaagctgtggccatctgcaaagggctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagctgtaagtagcccattctctctgactgccgggtattcacacacaaggtattcttgcctgtgcctcatgttttccaaatgctccctgaggggtagacgtcaatgtgtctactggaacatgggtgtatgtattcacacatatgcacaaaatcactggttactaagatggacattttccattggcccagcttagtctctataaagatggaaacgacgatgcctattgaatttttgtttcttcgattcaattattgtaactgtcttagctgacaactttctgagaatggttcttgggtgagcagagttcagatccatttttggactgtgataaaggatctaattttgccctcattctttctctt

SEQ ID NO: 436525 - DNA, 453 bp, Homo sapiens
gctccactcctgcttccagaccatggtaacttgtcccatggccctgggtattccacctccagggcttcaccaggctttggccaaagctatcttagcagcacccagcacagagatacctgcacccttccctttctagacacagaaagatgtaaggcccagggaagtcagctgagagttctgaggttgctactgagaaacgctctcccctgagacagatgctgtctcaacttagataaaggaattcaggcaactggttttataattaacagagcagggcctttctctgacagcaaggagtgacttggggacaggagctgggtgaaaaggttcacagcttgtggatctagatggttccattcagccctctagacctttggataaatgcacaagtacatctctgcaggttgcctgaggcctttgcatgggcctcattggagggaggatgttgcctga

SEQ ID NO: 436526 - DNA, 589 bp, Homo sapiens
ggaggtcaaaggctggtttctactgacctttgtgcccacacaacacctaacacagtgttttatgcataatgagtggctgttggttggcttgaaatgcatagcgtttaattaaatctctaaattcttgtgtctgccatagtgacctaaaacttgacaacgtgatgctcgattctgagggacacatcaagattgccgattttggcatgtgtaaggaaaacatctgggatggggtgacaaccaagacattctgtggcactccagactacatcgcccccgaggtgagagccgctgggcacacgttcacattgcggtgatgtaccctctgctccccagatggctgtgtgagagctgggaagggttgagggtggtaccttgcaagggaacctcggacagattcttattctatactctaaatcctccctttgagatcacacatgcaaattaatttagcacacatccagaagcccaagcccaaaatacatcaaggtttgggagaaaatttaaataaaacccgaaagaaccatccaacacacatcagtaacaattgcttcgtcttactattgtggctcacggccatgtgataccgcct

SEQ ID NO: 436527 - DNA, 2693 bp, Homo sapiens
agctgggcgagtgacagccccggctccgcgcgccgcggccgccagagccggcgcaggggaagcgcccggggccccgggtgcagcagcggccgccgcctcccgcgcctccccggcccgcagcccgcggtcccgcggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctggggcttcgggaagcagggattccagtgccaagtttgctgctttgtggtgcacaagcggtgccatgaatttgtcacattctcctgccctggcgctgacaagggtccagcctccgatgacccccgcagcaaacacaagtttaagatccacacgtactccagccccacgttttgtgaccactgtgggtcactgctgtatggactcatccaccaggggatgaaatgtgacacctgcatgatgaatgtgcacaagcgctgcgtgatgaatgttcccagcctgtgtggcacggaccacacggagcgccgcggccgcatctacatccaggcccacatcgacagggacgtcctcattgtcctcgtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagatttcagctgaaagaatcggacaaagacagaagactgtcagtagagatttgggattgggatttgaccagcaggaatgacttcatgggatctttgtcctttgggatttctgaacttcagaaagccagtgttgatggctggtttaagttactgagccaggaggaaggcgagtacttcaatgtgcctgtgccaccagaaggaagtgaggccaatgaagaactgcggcagaaatttgagagggccaagatcagtcagggaaccaaggtcccggaagaaaagacgaccaacactgtctccaaatttgacaacaatggcaacagagaccggatgaaactgaccgattttaacttcctaatggtgctggggaaaggcagctttggcaaggtcatgctttcagaacgaaaaggcacagatgagctctatgctgtgaagatcctgaagaaggacgttgtgatccaagatgatgacgtggagtgcactatggtggagaagcgggtgttggccctgcctgggaagccgcccttcctgacccagctccactcctgcttccagaccatggaccgcctgtactttgtgatggagtacgtgaatgggggcgacctcatgtatcacatccagcaagtcggccggttcaaggagccccatgctgtattttacgctgcagaaattgccatcggtctgttcttcttacagagtaagggcatcatttaccgtgacctaaaacttgacaacgtgatgctcgattctgagggacacatcaagattgccgattttggcatgtgtaaggaaaacatctgggatggggtgacaaccaagacattctgtggcactccagactacatcgcccccgagataattgcttatcagccctatgggaagtccgtggattggtgggcatttggagtcctgctgtatgaaatgttggctgggcaggcaccctttgaaggggaggatgaagatgaactcttccaatccatcatggaacacaacgtagcctatcccaagtctatgtccaaggaagctgtggccatctgcaaagggctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagctagagacaagagagacacctccaacttcgacaaagagttcaccagacagcctgtggaactgacccccactgataaactcttcatcatgaacttggaccaaaatgaatttgctggcttctcttatactaacccagagtttgtcattaatgtgtaggtgaatgcaaactccatcgttgagcctggggtgtaagacttcaagccaagcgtatgtatcaattctagtcttccaggattcacggtgcacatgctggcattcaacatgtggaaagcttgtcttagagggcttttctttgtatgtgtagcttgctagtttgttttctacatttgaaaatgtttagtttagaataagcgcattatccaattatagaggtacaattttccaaacttccagaaactcatcaaatgaacagacaatgtcaaaactactgtgtctgataccaaaatgcttcagtatttgtaatttttcaagtcagaagctgatgttcctggtaaaagtttttacagttattctataatatcttctttgaatgctaagcatgagcgatatttttaaaaattgtgagtaagctttgcagttactgtgaactattgtctcttggaggaagttttttgtttaagaattgatatgattaaactgaattaatatatgcaa

SEQ ID NO: 436528 - DNA, 2168 bp, Homo sapiens
gggaaagggagcgtttggcaagggtcgtgcactgcggaacactctaggcggtgatgagctctatgctgtgaagatcctgaagaaggacgttgtgatccaagatgatgacgtggagtgcactatggtggagaagcgggtgttggccctgcctgggaagccgcccttcctgacccagctccactcctgcttccagaccatggaccgcctgtactttgtgatggagtacgtgaatgggggcgacctcatgtatcacatccagcaagtcggccggttcaaggagccccatgctgtattttacgctgcagaaattgccatcggtctgttcttcttacagagtaagggcatcatttaccgtgacctaaaacttgacaacgtgatgctcgattctgagggacacatcaagattgccgattttggcatgtgtaaggaaaacatctgggatggggtgacaaccaagacattctgtggcactccagactacatcgcccccgagataattgcttatcagccctatgggaagtccgtggattggtgggcatttggagtcctgctgtatgaaatgttggctgggcaggcaccctttgaaggggaggatgaagatgaactcttccaatccatcatggaacacaacgtagcctatcccaagtctatgtccaaggaagctgtggccatctgcaaagggctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagcttgtgggcgaaatgctgaaaacttcgaccgatttttcacccgccatccaccagtcctaacacctcccgaccaggaagtcatcaggaatattgaccaatcagaattcgaaggattttcctttgttaactctgaatttttaaaacccgaagtcaagagctaagtagatgtgtagatctccgtccttcatttctgtcattcaagctcaacggctattgtggtgacatttttatgtttttcattgccaagttgcatccatgtttgattttctgatgagactagagtgacagtgtttcagaacccaaatgtcctcaggtagtttggagcatctctatgagatgggattatgcagatggcctatggaaaatgcagctgcataattaacacattatcaaagtcctcttacaatttattttccgcagcatgtcagctaagtagacccaatggggagagaaaatgcctgctttctttccctctttttctgcactgccatattcacccccaaccatccaatctgtggataattggatgttagcggtactcttccacttccgggcctggagcttggcttgtatccaagtgtatggttgctttgcctaagaggaatccctctatttcacctgttctggaggcaccagaccttgaaaagaacatgctcaaaataaaatgttatctgttatttttgtaaactcaaagttaagatgatcaaagttctaaaattccaagaatgtgcttttagacggtctcaatctaaaagcacttcaaggggtcaaagggcaaccagcttgggtgctacctcagtgttgtagtttctgatactttatgtctttgctcaccctcatccccaaactacttgaaaagggcatttggcaccactctctgaaacaacacagtcactctagcaaggcccccaaagggccctggttttacattacatttcaaactttatttgctttggggttttgtttctgttgttgttcaaatgcaaaaaaaagaaaaaaaaagaaaaaaaaaggtgactcacattgttacacatgctttaaaatatgtattcaaatgttattaaccacaatgacgacctgctttgatttaaccaagaagacggctgcggagcctagcagactcaggcctgtgggaatgggatttgttacaaatctaggtttgttactggcttcagaaagctaattaagtgctctgaaaaagacaccgtttcttgaaacaaagatggttgtattcctcactttgatgttgttttgcaagatgtttgtggaaatgttcatttgtatctggatctctgttatgtgccatttttcttctagcatcgagatacaataaaaaaaaaaaaaaag

SEQ ID NO: 436529 - DNA, 1248 bp, Homo sapiens
agctgggcgagtgacagccccggctccgcgcgccgcggccgccagagccggcgcaggggaagcgcccggggccccgggtgcagcagcggccgccgcctcccgcgcctccccggcccgcagcccgcggtcccgcggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctggggcttcgggaagcagggattccagtgccaagtttgctgctttgtggtgcacaagcggtgccatgaatttgtcacattctcctgccctggcgctgacaagggtccagcctccgatgacccccgcagcaaacacaagtttaagatccacacgtactccagccccacgttttgtgaccactgtgggtcactgctgtatggactcatccaccaggggatgaaatgtgacacctgcatgatgaatgtgcacaagcgctgcgtgatgaatgttcccagcctgtgtggcacggaccacacggagcgccgcggccgcatctacatccaggcccacatcgacagggacgtcctcattgtcctcgtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagatttcagctgaaagaatcggacaaagacagaagactgtcagtagagatttgggattgggatttgaccagcaggaatgacttcatgggatctttgtcctttgggatttctgaacttcagaaagccagtgttgatggctggaatccctggaagtccctgctgtgtggatagcacccttctcgatttccagcaaagatacagatgctctcttgtttttatatttcttttggtaatttccgtggaattttggaagaaaatttggaatattaaatgtggaggcgtagaggctcaaattgtcttctctgctttgaatcacctagcccatttttggaagctgcgtaagaagattcgtgaatggagagaaaacattgtgatgaaaattttaaac

SEQ ID NO: 436530 - DNA, 375 bp, Homo sapiens
cggtgcaggaccggcccacgctcttcctggaagtcatccagcgccacaaccaccagggttttggagccggcaacttcaactcactgttcaaggctttcgaggaggagcagaacctgcggggtaacctcaccaacatggagaccaatggggtggtgcccggcatgtaagccccgcccaccccacggaggccacagccacacagccacgccccctgattctggaactcgcccaacttccctactggctgctccccttgggtcccgcccaccagcggactcggcccccaaggctccgcccacactgaccacgcccctcggcggggccgccctctgctccagccctcccgattaaagcgtgccccggtccaatactgtg

SEQ ID NO: 436531 - DNA, 728 bp, Homo sapiens
tttttaaacattaaacatgtaaagttatatacgaaatatctgcttttggaataagcagaatgaggctaaacatgggttatacaaagggtatctggaaactgaagagcaacttgttagaaaactgacaatgtcgcaagatgtactcagttttgtttctgtgtgacatgcaatggcaactcatgtggacactattgaagggatgtgacattacctcctgtagatatgctaacagtgttattctttcatttccaagggttctctgtggctttgtgtatatgtttcccagaggtcatttgattacctaatttactgaactgatttagcagggaatggaatccattccaactattgcacgtggatttcccagctgcccctaaatatatatacttgtgagtggcaaagtggcactaatgaagcttttgccttttgtacatttgagatttttgtatatagtgtttgctgcaaggcctgtggaattaattcgttgcatatagaggtatcaactgctgcatgttcaggcatattataaaactttagtctatgaaagaataattataataatgtccaggtgcaatactctgtaagtctattggttcaagttaccgagagataggtgtgttcctttatgggggatgaatgggtttttctaacattctctgggccgtacctcacggtctttacggctcattaccccactctcttcggtctaattactttcttccgctctc

SEQ ID NO: 436532 - DNA, 2051 bp, Homo sapiens
tttttaaacattaaacatgtaaagttatatacgaaatatctgcttttggaataagcagaatgaggctaaacatgggttatacaaagggtatctggaaactgaagagcaacttgttagaaaactgacaatgtcgcaagatgtactcagttttgtttctgtgtgacatgcaatggcaactcatgtggacactattgaagggatgtgacattacctcctgtagatatgctaacagtgttattctttcatttccaagggttctctgtggctttgtgtatatgtttcccagaggtcatttgattacctaatttactgaactgatttagcagggaatggaatccattccaactattgcacgtggatttcccagctgcccctaaatatatatacttgtgagtggcaaagtggcactaatgaagcttttgccttttgtacatttgagatttttgtatatagtgtttgctgcaaggcctgtggaattaattcgttgcatatagaggtatcaactgctgcatgttcaggcatattataaaactttagtctatgaaagaataattataataatgtccaggtgcaatactctgtaagtctattggttcaagttaccgagagataggtgtgttcctttatgggggatgggggggtgtgttggggattctttgtattgtttatttcattttggtttattttaaaagatgtaaacatatattaagctatattaaatctcacatacagttcttctgtgctctattataccctgatagagatgggggagagaaaggaatgtttttgatggtggtttcaaagctcggacagtaactatcttgagcccattagagagtctgtgtccatatttgcatctggctggtcatagcctttgttactaatgatgacattcagttctcttttgtttttattttttaaaaactcaggtgtaattattatctgttcttaagataattgcaaatattaaatattatgatatatcaattcatgtgtttggcataccagtgaatgatgaagaacatgagattaatttaatttatcttcggtaacttgacattctggagagagactatcttctggagttgagtacaagcacagaaacatctttacggtggcatcatctcattttttaggaagacatgataatactgcccatcatattcatgtgtaactactgttctttcttctgctttcttcaccataataaactttggacaaccaagcaagctctaaccgcaatgccagatggccttgtccgagggcctagtgtttgcacggcagtgggaactgggcctttcctacaggacaactggcaagtttgctgggaagtcaaataatacattccacctggcagctgaaggcagccagtcagtctgtcccagaaagggcccttttcagcacccaaagctgggctggctgggatgcctctggctggtgaagttctcacataggctgatttaaatccagcaaaggtctatagaaaaaggcttgcgtgttcgttgagtaatcattgtttcattttcatttttacgagagtttgaaaatagacacactgttaacacttctgccagttttttctgatctttccagccccaccccctttctctttctctctctctctcaaagaaaaaaaaaatgggagtgcaaaaaaaacaaagccaaaaaatatatgaaggatagctgttcttctgtgttctctcattatggactttgtgaagtagaaacataattttttttcctccaaaggtgaaaaaacaatgcattcttgctttaaaaaaaaaaaagaaggctaaaaaattacctctttttaaattatgtgcaaaataattctggctaactgtaaaatgtattcaattttaggatttttttttttttgtattgtgatgctttatttgtacatttttttcctttctggatgtaattttaatctcttgccattcattagtgttatttcattgtaaacgttattgtgccaaatgtactgtattcaaaaggatgtgaatgtgtattgtttcagaacctaataaatacaatgacgttaagtctta

SEQ ID NO: 436533 - DNA, 2115 bp, Homo sapiens
caactgtgttagtaggctattcaaacgtcacacgtgtccaagtaatatactaaatatctgcattatggtggattaacgtagaagagatcggtaacattaggtattattgaagagagggctatatgagaataatgaagaggcaggtggtaaagaagaagctgactaagatgtaagcatacgatagtagctcgatgcttgtaggtcactgatcgtgacattgactcatgcgagagatctatagtggaaagcttatatgaatcgggatgtgacattacctcctgtagatatgctaacagtgttattctttcatttccaagggttctctgtggctttgtgtatatgtttcccagaggtcatttgattacctaatttactgaactgatttagcagggaatggaatccattccaactattgcacgtggatttcccagctgcccctaaatatatatacttgtgagtggcaaagtggcactaatgaagcttttgccttttgtacatttgagatttttgtatatagtgtttgctgcaaggcctgtggaattaattcgttgcatatagaggtatcaactgctgcatgttcaggcatattataaaactttagtctatgaaagaataattataataatgtccaggtgcaatactctgtaagtctattggttcaagttaccgagagataggtgtgttcctttatgggggatgggggggtgtgttggggattctttgtattgtttatttcattttggtttattttaaaagatgtaaacatatattaagctatattaaatctcacatacagttcttctgtgctctattataccctgatagagatgggggagagaaaggaatgtttttgatggtggtttcaaagctcggacagtaactatcttgagcccattagagagtctgtgtccatatttgcatctggctggtcatagcctttgttactaatgatgacattcagttctcttttgtttttattttttaaaaactcaggtgtaattattatctgttcttaagataattgcaaatattaaatattatgatatatcaattcatgtgtttggcataccagtgaatgatgaagaacatgagattaatttaatttatcttcggtaacttgacattctggagagagactatcttctggagttgagtacaagcacagaaacatctttacggtggcatcatctcattttttaggaagacatgataatactgcccatcatattcatgtgtaactactgttctttcttctgctttcttcaccataataaactttggacaaccaagcaagctctaaccgcaatgccagatggccttgtccgagggcctagtgtttgcacggcagtgggaactgggcctttcctacaggacaactggcaagtttgctgggaagtcaaataatacattccacctggcagctgaaggcagccagtcagtctgtcccagaaagggcccttttcagcacccaaagctgggctggctgggatgcctctggctggtgaagttctcacataggctgatttaaatccagcaaaggtctatagaaaaaggcttgcgtgttcgttgagtaatcattgtttcattttcatttttacgagagtttgaaaatagacacactgttaacacttctgccagttttttctgatctttccagccccaccccctttctctttctctctctctctcaaagaaaaaaaaaatgggagtgcaaaaaaaacaaagccaaaaaatatatgaaggatagctgttcttctgtgttctctcattatggactttgtgaagtagaaacataattttttttcctccaaaggtgaaaaaacaatgcattcttgctttaaaaaaaaaaaagaaggctaaaaaattacctctttttaaattatgtgcaaaataattctggctaactgtaaaatgtattcaattttaggatttttttttttttgtattgtgatgctttatttgtacatttttttcctttctggatgtaattttaatctcttgccattcattagtgttatttcattgtaaacgttattgtgccaaatgtactgtattcaaaaggatgtgaatgtgtattgtttcagaacctaataaatacaatgacgttaagtctta

SEQ ID NO: 436534 - DNA, 677 bp, Homo sapiens
  misc_feature (193)..(193): n is a, c, g, or t
atgtggagctggtggtgaagaatcccctgtgcccgctgggccaaactgtgcaaagtgagctctttcgctcccgactggactcctatgttcgctctctgcccttcttctccgcccgggctggctgaagcaacctacctcaagtctcaggagaattcatgtctgcctggggcccttccgaacctgtgccaactanagggcccccactgtaagcccccgcacccccaccccctttctctttctctctctctctcaaagaaaaaaaaaatgggagtgcaaaaaaaacaaagccaaaaaatatatgaaggatagctgttcttctgtgttctctcattatggactttgtgaagtagaaacataattttttttcctccaaaggtgaaaaaacaatgcattcttgctttaaaaaaaaaaaagaaggctaaaaaattacctctttttaaattatgtgcaaaataattctggctaactgtaaaatgtattcaattttaggatttttttttttttgtattgtgatgctttatttgtacatttttttcctttctggatgtaattttaatctcttgccattcattagtgttatttcattgtaaacgttattgtgccaaatgtactgtattcaaaaggatgtgaatgtgtattgtttcagaacctaataaatacaatgacgttaagtctta

SEQ ID NO: 436535 - DNA, 1367 bp, Homo sapiens
gcacctgagcagcctaaaggtgagtgtaatacagatgcacaagtgactggttgataatggaatgagaccccttataagaaagacataacagagcacggcagaggagcaagaacaacacagaggcaatgacatttgagctaggcctcttatatctgtagatgaacatttgatggtaggtagtagggaagatggaactaagaatatttgagctacttaatatatgccaggcagcatgctgagtgcttgtgttcatttaattctcaagacagccataagcggcagtacaggtattgggcctattattctaaatcccattttataagagagttaggattagattcagttccatctttctacaaaacctggcactgtcattccaggcaaagggagtacaatccatttttctcttaagaggttgattttgccaatgagacagaatgaatctctacagcattgttaagtttctacccagtcttttgggtgactgaaaaattcaaatgtaaagatgtggcaaaattggttctctaaggattttaagtacagccaaatgatatgtcacaagttttttcctaaatatccaaccatttagtctttcataagcttttaattccactagcctcactttctgagattgttgatgttttcttgttctaacctgaaattttctttgtttgatgttaacaggagtataatgaaggagtaaccatttttattttatgatagtctatcaatagactttttttaaccttctttaagctaggtgtgtttgtcctttattaaagtcagtttgacccagcctgtacaacattgcaagaccttaactttaataaaaaaaaaaaaaaaaaaaaaaagccaggtgtggtggtgcatgcctgtaatcccagctacttgggaggctgagatgggaggatcacttgagcccaggagattgaggctgcagtgacccgtgactgcgccactacactacagcctgggtgacagaacaagacactgttgatagatagactatatgaaacacgctctataaccaaaaaaatcattgctctggatataatgcaaagattttggtaacattttaccgtattttttcttattgattgattagagtagtggaggaggggagaaggaatttaagagatactatcatcaaccacttgcagattttagtatatttatacgctgctcttctcagtatttcatttttctatacatgagaaaagactatgtctgtattggaccattacaattgaccactttgttgaagacatcttcagttgtgacataggtcattttgatttgaacgaactgatagctataccaattttttttggctctgtgggaattttgggatagagaatgttatttga

SEQ ID NO: 436536 - DNA, 2800 bp, Homo sapiens
ctgactgagtccctggaagagtagtaattccaacaattccagccatttgttcaattaattttcccaacattcttctcccagtgctgggaatcacatttcctctgttctgtgcagaagacaaaaaggcaatcataaaagtttgttatatttgtgggggtgcctggaggaggattttcctcaacttaatggagccactgtccataaagtggctgttatcccttcatataattggtgagatcagccttctccttgacttggcacctaattatgcttcatgagatcctagattccacctgagtcaattgtgtccagagccccaaaccaggatggagttgttttccccagatatggggttctattcagccatagataatctagacagaggatttcagaatgaaaggaaaaatgtgtggagattagtcctagttcattctgagggccgactaagtggctcagccagcttcttactccatctgcagttcatactgccaaagagctcccacttccaaatccccagtgactttatggagaagattctgcattaaattgtctttcgaatgatggggaagcaaggcataatatgcgatgatgaggagaaagtagaccagtgaggtgattgcaagactaacaaggagactcaatgggaagtttttctttcttttagatattgcttttgaagtagatggtaaaatttttgtcatccttcttgtattttttgtaccccaagttacaatttttcttcttccttgtaaataatttaaacagtatttatttttgtaaggcataactagaaactaaaatatattctaaaaaattcattattctgaacaaagtgatcaaattagaatacatatttttcaacagtggtagagcttttaatatatgtttattgaaagttatctataatacttgcaccagtgttgaaaaaagttaacatgtaggcaagagcaatatgtttgtctcaaggatttttccatggtttcctcagtgatggtgtcctgggaattattcaggtggtgaccatcactgggtctaagtttgtgtgcaggggttttcagacgtgtttttgtgaaacttggtagaaccatggctaataaagaggacagtgttgtcagggtccatctgccctccatagaaaaatgtctctggctcataaaatgagactccctcagggactaaatatgaactgacagcagtaactctgatacagaataatctaaattgcatcaaatggccttaattcagagtttgttaggcttatcagtatgttgcttttaattggggtgggaaagtagagggagagaaagcaagacatttattaagcacctcgtatgtgccaggcactatgctaagcactttacataagttaggattaatccctgcaagaatcctataaagaatgttactagcatttacacttcccaaatgaaggtaccaaagctcaaacgcaatgttgtgaagctgtttccttcagatttaggttatgtgggatgatgtgggattgaagaggaaagaaaggtgggattatccccctaggaagactttcaggcctgacttcataggaattcatccatcttatcatgtggagtttatctcaccctgctgttgcaggatgctatttgcatgtgtccccaggtgatgttttttctttggggagtaggggtttggcttcctcattcatccctcttgctaaaagaggagatagttgatgttgcatctaaagatgctataagacaatgaaagtttgatgttgtacatacctacaagtaccatttttgtgcatgattacactccactgacatcttccaagtactgcatgtgattgaataagaaacaagaaagtgaccacaccaaagcctccctggctggtgtacagggatcaggtccacagtggtgcagattcaaccaccacccagggagtgcttgcagactctgcatagatgttgctgcatgcgtcccatgtgcctgtcagaatggcagtgtttaattctcttgaaagaaagttatttgctcactatccccagcctcaaggagccaaggaagagtcattcacatggaaggtccgggactggtcagccactctgacttttctaccacattaaattctccattacatctcactattggtaatggcttaagtgtaaagagccatgatgtgtatattaagctatgtgccacatatttatttttagactctccacagcattcatgtcaatatgggattaatgcctaaactttgtaaatattgtacagtttgtaaatcaatgaataaaggttttgagtgtatcttaccaggctcctccctgcaaatgcacatgtcaatcaatgattaatgcacccaggttatgtacaaggcactgggcttagcaccacagggaacttccttccagaggctcgctttctagttgtgtagacaagaatacatgcatgagaagatacaagacaattcacccatgccaaatgattcatacaggctgtttaagtactgcagaaaataaaagaaggaaaggctaccagacttttcaataaggtctacagcttcccaagagcatgtctttgttaaatcaggaaatataaaaattatgtgtgtatgtgtatgtatatatatataccaccctattaactattttaaaatcgtattctattttgggggttgtgttaatgatgatgaaccagaaaagattttctcttgatggtttcttcaacaggaaacagatattggaatagtgtacatgtcatttttatctatacaatgaatttattatgtttttcttagtaaagtgatagacattgaaagcaa

SEQ ID NO: 436537 - DNA, 2286 bp, Homo sapiens
ctgactgagtccctggaagagtagtaattccaacaattccagccatttgttcaattaattttcccaacattcttctcccagtgctgggaatcacatttcctctgttctgtgcagaagacaaaaaggcaatcataaaagtttgttatatttgtgggggtgcctggaggaggattttcctcaacttaatggagccactgtccataaagtggctgttatcccttcatataattggtgagatcagccttctccttgacttggcacctaattatgcttcatgagatcctagattccacctgagtcaattgtgtccagagccccaaaccaggatggagttgttttccccagatatggggttctattcagccatagataatctagacagaggatttcagaatgaaaggaaaaatgtgtggagattagtcctagttcattctgagggccgactaagtggctcagccagcttcttactccatctgcagttcatactgccaaagagctcccacttccaaatccccagtgactttatggagaagattctgcattaaattgtctttcgaatgatggggaagcaaggcataatatgcgatgatgaggagaaagtagaccagtgaggtgattgcaagactaacaaggagactcaatgggaagtttttctttcttttagatattgcttttgaagtagatggtaaaatttttgtcatccttcttgtattttttgtaccccaagttacaatttttcttcttccttgtaaataatttaaacagtatttatttttgtaaggcataactagaaactaaaatatattctaaaaaattcattattctgaacaaagtgatcaaattagaatacatatttttcaacagtggtagagcttttaatatatgtttattgaaagttatctataatacttgcaccagtgttgaaaaaagttaacatgtaggcaagagcaatatgtttgtctcaaggatttttccatggtttcctcagtgatggtgtcctgggaattattcaggtggtgaccatcactgggtctaagtttgtgtgcaggggttttcagacgtgtttttgtgaaacttggtagaaccatggctaataaagaggacagtgttgtcagggtccatctgccctccatagaaaaatgtctctggctcataaaatgagactccctcagggactaaatatgaactgacagcagtaactctgatacagaataatctaaattgcatcaaatggccttaattcagagtttgttaggcttatcagtatgttgcttttaattggggtgggaaagtagagggagagaaagcaagacatttattaagcacctcgtatgtgccaggcactatgctaagcactttacataagttaggattaatccctgcaagaatcctataaagaatgttactagcatttacacttcccaaatgaaggtaccaaagctcaaacgcaatgttgtgaagctgtttccttcagatttaggttatgtgggatgatgtgggattgaagaggaaagaaaggtgggattatccccctaggaagactttcaggcctgacttcataggaattcatccatcttatcatgtggagtttatctcaccctgctgttgcaggatgctatttgcatgtgtccccaggtgatgttttttctttggggagtaggggtttggcttcctcattcatccctcttgctaaaagaggagatagttgatgttgcatctaaagatgctataagacaatgaaagtttgatgttgtacatacctacaagtaccatttttgtgcatgattacactccactgacatcttccaagtactgcatgtgattgaataagaaacaagaaagtgaccacaccaaagcctccctggctggtgtacagggatcaggtccacagtggtgcagattcaaccaccacccagggagtgcttgcagactctgcatagatgttgctgcatgcgtcccatgtgcctgtcagaatggcagtgtttaattctcttgaaagaaagttatttgctcactatccccagcctcaaggagccaaggaagagtcattcacatggaaggtccgggactggtcagccactctgacttttctaccacattaaattctccattacatctcactattggtaatggcttaagtgtaaagagccatgatgtgtatattaagctatgtgccacatatttatttttagactctccacagcattcatgtcaatatgggattaatgcctaaactttgtaaatattgtacagtttgtaaatcaatgaataaaggttttgagtgta

SEQ ID NO: 436538 - DNA, 3674 bp, Homo sapiens
  misc_feature (560)..(560): n is a, c, g, or t
tgtgctctgtggagagagatacaatgatttagagaagcatatatgttcagtaaaacatgatgatgtttattttgatcattttcatccctgtgctgcgctaacgacagatattattgaaaagtatggattcccacctgatcttaccctcacccctcaagaaagcatccagctttatgataccatggctcaagtctgggaaacttggcccagggctcaggaattgtgtccagaggaattcattctttttaagaataagatagtcattaagaagttggatgctagaaaatatgaagaaaacttaaaggcagaattgacaaattggattaaaaatggccaagtgaagaaggtcaaaagagtactgaagaaccttagtccggattcattgtctagttcaaaagatatggtgaaaatgtttcctcttcttgttgaaaagttaagacaaatggataagttgcctgcaatattttttttgtttaagaatgatgatgtgggaaaaagagctggaagtgtgtgcacttttctggagaagacagagacaaaaagccatccccacactgaangtcatagttatgtctttgcaatagatgaagtacttgaaaaagtgaggaagacacagaaaaggatcactaaaaaaaaacccaaagaaggctgaaaaactggaaagaaaaaaagtgtatagagctgaatatattaatttcctggagaatctgaagattctggaaatttctgaggactgcacgtatgctgatgtcaaagccctacacactgaaattaccaggaataaagactcaactttggatagggtattaccgcgagtgcgatttacaagacacggcaaagaactgaaggctttagcacaaagggggattggatatcatcacagcagcatgtattttaaagaaaaagagtttgttgagatactctttgtaaaagggcttattagggtagtgacagctactgaaacacttgccttagggatccacatgccatgcaaatctgttgtttttgcccaagactcagtctatctggatgctttaaattacagacagatgtctggtcgtgctggaagaagaggtcaagacctgcttggaaatgtgtatttctttgatatcccattgcccaaaataaaaagactccttgcatccagtgttcctgagctgagaggacagttccctctcagcataaccctggtcctgcgactcatgctgctggcttccaagggagatgacccagaggatgccaaggcaaaggtgttgtcagtgctaaagcattcattgctgtcttttaagagacgaagagccatggagactttgaaactttactttttgttttccttgcagctccttatcaaagaggactatttaaataaaaagggtaatccaaagaaatttgcaggacttgcatcatatttgcatggtcatgaaccttcaaatcttgtttttgtaaattttctcaagagaggccttttccataatctctgtaagccagcctggaaaggctcacaacaattttcccaagatgtgatggaaaagctcgtgttagtattggcaaatttgtttggaagaaaatatattccagcaaaattccaaaatgctaatttaagtttttctcagtcaaaggtgatccttgccgaactcccggaggattttaaagctgctttatatgagtataacctggcagtaatgaaggattttgcctccttcctgctgattgcttccaagtcggtgaacatgaaaaaagagcatcaactccctttgtcaagaatcaaattcacaggtaaagaatgtgaagactcccaactcgtgtctcacttgatgagctgcaagaaaggaagagtagccatttcaccatttgtttgtctttcggggaacacagataatgatttgcttcgaccagagactatcaaccaggtcatcctgcgcacagtcggtgttagtggcactcaggctcctctgctgtggccatggaaattagataaccgaggaaggagaatgccactaaatgcatatgtgctcaatttctataaacacaactgcttgacaagattagaccaaaaaaatgggatgcgtgtgggacagcttttaaagtgtttgaaagattttgcattcaacattcaggctatcagtgactccttgagtgaactatgtgaaaataagcgtgacaatgtagtcctggcatttaaacaattgagtcaaaccttttatgagaaacttcaagaaatgcaaattcaaatgagtcaaaatcatttagaataacaccatggaaaactttcaagtctgattatgtggtatttatccctttgcaaggagagatataattaagcttacacaatgaaatggaaaaaatgtttgtcttggagtcaaacagaattaaactcagataccagctctgctattttctaactgaatgactttaagttatgtaatatatctgagctttaacttcatttttggcaaaaccagagtaaaaatgaatacctctagttgttttgaggattaaatgagataatgtaagaaaagtgattgggattgggtggtgacttaatgaacggtagtggttttttaagtagttaatgtatagcaaaattagtttcacattgtcaagttttcaatacatccccaagttaattgaattttaaattaatgatcaataaatcacaaaggacccaaatcaattctgaacaacaatttagttatgtaagaagacttctgagattacaagaaactcactgctgtggactggatgtttgtgccctcccctccaaaatttttatattgaaattctaaccctcaatgtgatggtattaggagatgataggtcatgagggtggagctccttggatgtaattagtgcctttaacagagagacaagagagcttgttctccaatctctgctcactaccactggatgatacaatgggaagatggccatctgcagaccaagaagcaagccctcaacagaactgaatctacttacaccatgatcttgaactttccagcctccaggattgtgagaaatacatgtttgttgtttagccatctagtctgtggttttctgttgaagcagtctgaattgactaaaacagtcacttggagtagttataaaccactttcctgttgaaagcagaacatgctgattcaactgttttgttcaatagcaatgatagattttgtttaagtcccctacactttcttatttctaaatgatcaagagtacacttcctggcagtgattaaggagtgtgtatctaacagaaaaaatatatataccctgtgaacccgaatatggaattcagattgtttctgccctcagtatcatacttaaaaaacaagcatacaaacaaacataagggaacaaacagcaaccataacaaaaacaaacctttaaaggtgggtttttgctgtgataaatgaatacggtactctgaaggagaaaaaagtttctcaaatgagcttaaactgcaagtgatttaaaaattagagaatataattcttaaagctattgaaagtttcaaccagaaaacctcaagtgaattttgtatgtaaatgaaatcttgaatgtaagttctgtgattctttaagcaaacaattagctgaaaacttggtattgttgtagtttatgtagtaagtgacttggcacccatcagaaaataaagggcattaaattgaaaaaaag

SEQ ID NO: 436539 - DNA, 3515 bp, Homo sapiens
  misc_feature (712)..(712): n is a, c, g, or t
  misc_feature (880)..(880): n is a, c, g, or t
  misc_feature (898)..(898): n is a, c, g, or t
  misc_feature (913)..(913): n is a, c, g, or t
  misc_feature (1442)..(1442): n is a, c, g, or t
acaagtctttaggatccaaactttccctcatcttcctgtcttcttctgagccctccacaaaattccaacctctgtccactatgcagttcaaaatcgcttccacattttcagatatctttatagcagtgccccactcctcagtatcaacttcctgtattagttcattctcacgctgctatacagagacacttgagactgggtaatttataaagaaaagacattttattggcttatggttctgcaggctgtacaggaagcataagtagcttctgcttctgggtaggcctcaggaaactttcaatcatgtcagaaagtgaagcagaagtaggccatgtgttacatgcatggctggagcaggaggaagagaggtagaagggaggtgctacacacttttaaacaaccagatctcatgataactcactatcatgagaacagcaccaaaggggaaattcacctccatgatccaatcacctccaatcaggccccacctccaacactggggattacaatttgacatgaaatttgggtgatgacacagatccaaatatttccattctgttgactgcaatctacctaattccattaggtttaatgggataactcaagattcagaacaatataattactctatttacctttagaatggcctaagacaactaatcttgtaagccggattggctttcatacttcattttttcaggccactattggncaccactgtttcagggatttagcagattatttgccaatctgggttatgtataacagttctgctttatatgatgtatttaattcaaggaagcatgtgccatgtgaagatacaatcaaagagataatatgaaatcaaatgaaatttactttcacgtaagatctggtaacnttatctatatagtatgtntgtgtactatttatnacatatcagtatttacaaatactgtttaaaactagataaattaaagtactcttcttttataggtgttgtcagtgctaaagcattcattgctgtcttttaagagacgaagagccatggagactttgaaactttactttttgttttccttgcagctccttatcaaagaggactatttaaataaaaagggtaatccaaagaaatttgcaggacttgcatcatatttgcatggtcatgaaccttcaaatcttgtttttgtaaattttctcaagagaggccttttccataatctctgtaagccagcctggaaaggctcacaacaattttcccaagatgtgatggaaaagctcgtgttagtattggcaaatttgtttggaagaaaatatattccagcaaaattccaaaatgctaatttaagtttttctcagtcaaagacacaacaacaaaataataacaagcaaacagaacccaagaaaatgtgcattagaacctgggaatgtagaagaagcttgtttctatccagtaaccctantgaatagagaacaaaaaggtgatccttgccgaactcccggaggattttaaagctgctttatatgagtataacctggcagtaatgaaggattttgcctccttcctgctgattgcttccaagtcggtgaacatgaaaaaagagcatcaactccctttgtcaagaatcaaattcacaggtaaagaatgtgaagactcccaactcgtgtctcacttgatgagctgcaagaaaggaagagtagccatttcaccatttgtttgtctttcggggaacacagataatgatttgcttcgaccagagactatcaaccaggtcatcctgcgcacagtcggtgttagtggcactcaggctcctctgctgtggccatggaaattagataaccgaggaaggagaatgccactaaatgcatatgtgctcaatttctataaacacaactgcttgacaagattagaccaaaaaaatgggatgcgtgtgggacagcttttaaagtgtttgaaagattttgcattcaacattcaggctatcagtgactccttgagtgaactatgtgaaaataagcgtgacaatgtagtcctggcatttaaacaattgagtcaaaccttttatgagaaacttcaagaaatgcaaattcaaatgagtcaaaatcatttagaataacaccatggaaaactttcaagtctgattatgtggtatttatccctttgcaaggagagatataattaagcttacacaatgaaatggaaaaaatgtttgtcttggagtcaaacagaattaaactcagataccagctctgctattttctaactgaatgactttaagttatgtaatatatctgagctttaacttcatttttggcaaaaccagagtaaaaatgaatacctctagttgttttgaggattaaatgagataatgtaagaaaagtgattgggattgggtggtgacttaatgaacggtagtggttttttaagtagttaatgtatagcaaaattagtttcacattgtcaagttttcaatacatccccaagttaattgaattttaaattaatgatcaataaatcacaaaggacccaaatcaattctgaacaacaatttagttatgtaagaagacttctgagattacaagaaactcactgctgtggactggatgtttgtgccctcccctccaaaatttttatattgaaattctaaccctcaatgtgatggtattaggagatgataggtcatgagggtggagctccttggatgtaattagtgcctttaacagagagacaagagagcttgttctccaatctctgctcactaccactggatgatacaatgggaagatggccatctgcagaccaagaagcaagccctcaacagaactgaatctacttacaccatgatcttgaactttccagcctccaggattgtgagaaatacatgtttgttgtttagccatctagtctgtggttttctgttgaagcagtctgaattgactaaaacagtcacttggagtagttataaaccactttcctgttgaaagcagaacatgctgattcaactgttttgttcaatagcaatgatagattttgtttaagtcccctacactttcttatttctaaatgatcaagagtacacttcctggcagtgattaaggagtgtgtatctaacagaaaaaatatatataccctgtgaacccgaatatggaattcagattgtttctgccctcagtatcatacttaaaaaacaagcatacaaacaaacataagggaacaaacagcaaccataacaaaaacaaacctttaaaggtgggtttttgctgtgataaatgaatacggtactctgaaggagaaaaaagtttctcaaatgagcttaaactgcaagtgatttaaaaattagagaatataattcttaaagctattgaaagtttcaaccagaaaacctcaagtgaattttgtatgtaaatgaaatcttgaatgtaagttctgtgattctttaagcaaacaattagctgaaaacttggtattgttgtagtttatgtagtaagtgacttggcacccatcagaaaataaagggcattaaattgaaaaaaag

SEQ ID NO: 436540 - DNA, 1840 bp, Homo sapiens
tttcaccctccccctttgataatggtcaaattatctctttaataattttttttgtggtttttacctatgcctctcaatttcattatgattaatacaatagaatgcttaactgggagtgcatttggcagataaattaactgccatggacagaccactattaaagtttgagttaattcttttatgtttatgtttttatactttttaattaagaaatgttgttctctttaggatgcgtgtgggacagcttttaaagtgtttgaaagattttgcattcaacattcaggctatcagtgactccttgagtgaactatgtgaaaataagcgtgacaatgtagtcctggcatttaaacaattgagtcaaaccttttatgagaaacttcaagaaatgcaaattcaaatgagtcaaaatcatttagaataacaccatggaaaactttcaagtctgattatgtggtatttatccctttgcaaggagagatataattaagcttacacaatgaaatggaaaaaatgtttgtcttggagtcaaacagaattaaactcagataccagctctgctattttctaactgaatgactttaagttatgtaatatatctgagctttaacttcatttttggcaaaaccagagtaaaaatgaatacctctagttgttttgaggattaaatgagataatgtaagaaaagtgattgggattgggtggtgacttaatgaacggtagtggttttttaagtagttaatgtatagcaaaattagtttcacattgtcaagttttcaatacatccccaagttaattgaattttaaattaatgatcaataaatcacaaaggacccaaatcaattctgaacaacaatttagttatgtaagaagacttctgagattacaagaaactcactgctgtggactggatgtttgtgccctcccctccaaaatttttatattgaaattctaaccctcaatgtgatggtattaggagatgataggtcatgagggtggagctccttggatgtaattagtgcctttaacagagagacaagagagcttgttctccaatctctgctcactaccactggatgatacaatgggaagatggccatctgcagaccaagaagcaagccctcaacagaactgaatctacttacaccatgatcttgaactttccagcctccaggattgtgagaaatacatgtttgttgtttagccatctagtctgtggttttctgttgaagcagtctgaattgactaaaacagtcacttggagtagttataaaccactttcctgttgaaagcagaacatgctgattcaactgttttgttcaatagcaatgatagattttgtttaagtcccctacactttcttatttctaaatgatcaagagtacacttcctggcagtgattaaggagtgtgtatctaacagaaaaaatatatataccctgtgaacccgaatatggaattcagattgtttctgccctcagtatcatacttaaaaaacaagcatacaaacaaacataagggaacaaacagcaaccataacaaaaacaaacctttaaaggtgggtttttgctgtgataaatgaatacggtactctgaaggagaaaaaagtttctcaaatgagcttaaactgcaagtgatttaaaaattagagaatataattcttaaagctattgaaagtttcaaccagaaaacctcaagtgaattttgtatgtaaatgaaatcttgaatgtaagttctgtgattctttaagcaaacaattagctgaaaacttggtattgttgtagtttatgtagtaagtgacttggcacccatcagaaaataaagggcattaaattgaaaaaaag

SEQ ID NO: 436541 - DNA, 637 bp, Homo sapiens
gtgaggaaggggagaccaagtcaggattgatggagctactgtcaacgtcggatgaccaagggaaatctgtggggccttaggcttcttgcagtaactgaatatgagttttcattacttaaaagtttttttttttttttaaatagtagcactaaaaaaaaacccaaagaaggctgaaaaactggaaagaaaaaaagtgtatagagctgaatatattaatttcctggagaatctgaagattctggaaatttctgaggactgcacgtatgctgatgtcaaagccctacacactgaaattaccaggaataaagactcagtacgtcagagaattattaatataatacgttacagttgtgacattttatcatagtgatcgtttaatatctttgaacactgaaatgacttgtgtaatacctttgaaatatgattatctctgtgtgtgattttgtttgttttgcaatgattatcccaatttaatgtgctaaagttctataagtgactcttccttgctcagtgtgaatgtcagcctcttattttatttcactctattatcctggattagtttatagcctgattctagaattcaattcaatatgatatattttaattctggtcacgtttgggttttatgacacaatat

SEQ ID NO: 436542 - DNA, 1285 bp, Homo sapiens
  misc_feature (560)..(560): n is a, c, g, or t
tgtgctctgtggagagagatacaatgatttagagaagcatatatgttcagtaaaacatgatgatgtttattttgatcattttcatccctgtgctgcgctaacgacagatattattgaaaagtatggattcccacctgatcttaccctcacccctcaagaaagcatccagctttatgataccatggctcaagtctgggaaacttggcccagggctcaggaattgtgtccagaggaattcattctttttaagaataagatagtcattaagaagttggatgctagaaaatatgaagaaaacttaaaggcagaattgacaaattggattaaaaatggccaagtgaagaaggtcaaaagagtactgaagaaccttagtccggattcattgtctagttcaaaagatatggtgaaaatgtttcctcttcttgttgaaaagttaagacaaatggataagttgcctgcaatattttttttgtttaagaatgatgatgtgggaaaaagagctggaagtgtgtgcacttttctggagaagacagagacaaaaagccatccccacactgaangtcatagttatgtctttgcaatagatgaagtacttgaaaaagtgaggaagacacagaaaaggatcactaaaaaaaaacccaaagaaggctgaaaaactggaaagaaaaaaagtgtatagagctgaatatattaatttcctggagaatctgaagattctggaaatttctgaggactgcacgtatgctgatgtcaaagccctacacactgaaattaccaggaataaagactcaactttggatagggtattaccgcgagtgcgatttacaagacacggcaaagaactgaaggctttagcacaaagggggattggatatcatcacagcagcatgtattttaaagaaaaagagtttgttgagatactctttgtaaaagggcttattagggtagtgacagctactgaaacacttgccttagggatccacatgccatgcaaatctgttgtttttgcccaagactcagtctatctggatgctttaaattacagacagatcatgtgaactctcctagactggaatatgaagactgtgattttacagagaaaaggagtttatctccatttcatgaccttttaggatgttgctgtttcaactttaaaagccatattttccttttctcaagtatagctatagaccatatcaccttttaccatgttctgttatgaaaaacaggaagtccctgagctggaatttttcagtctttctctttttcatgtagagagcaaagt

SEQ ID NO: 436543 - DNA, 939 bp, Homo sapiens
  misc_feature (22)..(22): n is a, c, g, or t
  misc_feature (27)..(28): n is a, c, g, or t
  misc_feature (30)..(30): n is a, c, g, or t
  misc_feature (37)..(37): n is a, c, g, or t
aaaaagttaggctagtacgagnctggnntnaatcggncgagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatggctgacgataaggagggggacgagaaaaaacgtcgaccggggcggaccagtaggttagacccctggaaacaaaggtagtaaaaggcacagtgaggagca

SEQ ID NO: 436544 - DNA, 1692 bp, Homo sapiens
acagggcggggtttcccgcgctcggcggaagcggaaggggcggggctccgcgctcctagtctccactgctgccgccgtcgccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggaactccagaagtgcttcgatgtgaaggacgtgcagatgctgcaggacgccatcagcaagatggaccccaccgacgcaaagtaccacatgcagcgctgcattgactctggcctctgggtccccaactctaaggccagcgaggccaaggagggagaggaggcaggtcctggggacccattactggaaggctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcagccccccatcagcattatccaaagggccgggggtccggggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctctctgggctgctgggagg

SEQ ID NO: 436545 - DNA, 1808 bp, Homo sapiens
acagggcggggtttcccgcgctcggcggaagcggaaggggcggggctccgcgctcctagtctccactgctgccgccgtcgccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggaactccagaagtgcttcgatgtgaaggacgtgcagatgctgcaggacgccatcagcaagatggaccccaccgacgcaaagtaccacatgcagcgctgcattgactctggcctctgggtccccaactctaaggccagcgaggccaaggagggagaggaggcaggtcctggggacccattactggaaggctgttcccaagacgggcgatgagaaggatgtcagtgtgtgacctgccccagctaccaccgccacctgcttccaggcccctatgtgccccttttcagaaaacagatagatgccatctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaagaagggggtggggcgttgtgtaattaagtattatatcggatggtagtgcaaagtcagcaagaaaacattatttagtgatataaaggtagggtattctataatagtgtgggtttaataattttaaagaaacaggcacgcgctgtcatctttaacaacaacagtcgacgcaggcggcgaaaaacaacgcccctaagatgatcacttattcgtattgcgacacacctctctcactttctgagggctggcgtcaacacttgagctgtggtagcaccaactctccaccacgcactgattacagcacgtgccgtcagcgagacgagtataaacagcaagctcagcgatacatttagataggca

SEQ ID NO: 436546 - DNA, 1032 bp, Homo sapiens
acagggcggggtttcccgcgctcggcggaagcggaaggggcggggctccgcgctcctagtctccactgctgccgccgtcgccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatggctgacgataaggagggggacgagaaaaaacgtcgaccggggcggaccagtaggttagacccctggaaacaaaggtagtaaaaggcacagtgaggagca

SEQ ID NO: 436547 - DNA, 1258 bp, Homo sapiens
acagggcggggtttcccgcgctcggcggaagcggaaggggcggggctccgcgctcctagtctccactgctgccgccgtcgccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcagccccccatcagcattatccaaagggccgggggtccggggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctctctgggctgctgggagg

SEQ ID NO: 436548 - DNA, 1783 bp, Homo sapiens
acagggcggggtttcccgcgctcggcggaagcggaaggggcggggctccgcgctcctagtctccactgctgccgccgtcgccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggtgagtggggcttgtgggttatggggggcaaggtcgaggcaggccctttgcctccagggccctccagcaccttgccagcatcttcccacaggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggaactccagaagtgcttcgatgtgaaggacgtgcagatgctgcaggacgccatcagcaagatggaccccaccgacgcaaagtaccacatgcagcgctgcattgactctggcctctgggtccccaactctaaggccagcgaggccaaggagggagaggaggcaggtcctggggacccattactggaaggctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcagccccccatcagcattatccaaagggccgggggtccggggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctctctgggctgctgggagg

SEQ ID NO: 436549 - DNA, 1604 bp, Homo sapiens
  misc_feature (22)..(22): n is a, c, g, or t
  misc_feature (27)..(28): n is a, c, g, or t
  misc_feature (30)..(30): n is a, c, g, or t
  misc_feature (37)..(37): n is a, c, g, or t
aaaaagttaggctagtacgagnctggnntnaatcggncggccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggaactccagaagtgcttcgatgtgaaggacgtgcagatgctgcaggacgccatcagcaagatggaccccaccgacgcaaagtaccacatgcagcgctgcattgactctggcctctgggtccccaactctaaggccagcgaggccaaggagggagaggaggcaggtcctggggacccattactggaaggctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcagccccccatcagcattatccaaagggccgggggtccggggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctctctgggctgctgggagg

SEQ ID NO: 436550 - DNA, 686 bp, Homo sapiens
acagggcggggtttcccgcgctcggcggaagcggaaggggcggggctccgcgctcctagtctccactgctgccgccgtcgccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggtccccagccaaggggccggctctcgtcactgggctctgttttcactgttcgtctgctgtctgtgtcttctatttggcaaacagcaatgatcttccaataaaagatttcagatgctctctgggctgctgggagg

SEQ ID NO: 436551 - DNA, 911 bp, Homo sapiens
acagggcggggtttcccgcgctcggcggaagcggaaggggcggggctccgcgctcctagtctccactgctgccgccgtcgccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggagaggaggcaggtcctggggacccattactggaaggctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcagccccccatcagcattatccaaagggccgggggtccggggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctctctgggctgctgggagg

SEQ ID NO: 436552 - DNA, 229 bp, Homo sapiens
tgagagcatctgaaatcttttattggaagatcattgctgtttgccaaatagaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctctctgggctgctgggagg

SEQ ID NO: 436553 - DNA, 772 bp, Homo sapiens
acagggcggggtttcccgcgctcggcggaagcggaaggggcggggctccgcgctcctagtctccactgctgccgccgtcgccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcagcaggaggaattccgcgagcagcaggagg

SEQ ID NO: 436554 - DNA, 1560 bp, Homo sapiens
acagggcggggtttcccgcgctcggcggaagcggaaggggcggggctccgcgctcctagtctccactgctgccgccgtcgccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggaactccagaagtgcttcgatgtgaaggacgtgcagatgctgcaggacgccatcagcaagatggaccccaccgacgcaaagtaccacatgcagcgctgcattgactctggcctctgggtccccaactctaaggccagcgaggccaaggagggagaggaggcaggtcctggggacccattactggaaggctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctgggggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctctctgggctgctgggagg

SEQ ID NO: 436555 - DNA, 1649 bp, Homo sapiens
  misc_feature (22)..(22): n is a, c, g, or t
  misc_feature (27)..(28): n is a, c, g, or t
  misc_feature (30)..(30): n is a, c, g, or t
  misc_feature (37)..(37): n is a, c, g, or t
aaaaagttaggctagtacgagnctggnntnaatcggncggccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggaactccagaagtgcttcgatgtgaaggacgtgcagatgctgcaggacgccatcagcaagatggaccccaccgacgcaaagtaccacatgcagcgctgcattgactctggcctctgggtccccaactctaaggccagcgaggccaaggagggagaggaggcaggtcctggggacccattactggaaggctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcagccccccatcagcattatccaaagggccgggggtccggggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctctctgggctgctgggagg

SEQ ID NO: 436556 - DNA, 1071 bp, Homo sapiens
  misc_feature (1059)..(1059): n is a, c, g, or t
acagggcggggtttcccgcgctcggcggaagcggaaggggcggggctccgcgctcctagtctccactgctgccgccgtcgccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcttcgggagttcttcactaanaataaaaaagcg

SEQ ID NO: 436557 - DNA, 1845 bp, Homo sapiens
acagggcggggtttcccgcgctcggcggaagcggaaggggcggggctccgcgctcctagtctccactgctgccgccgtcgccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaaggcccatgcccacgctcccgccaccttgatgctcatggcttcgtcaccacctccgccgtggatgggatgggcgctgcgaccacggcccgcccggccgcgctcgaggcgctccgcagccttgccccagcccactccccctctcaccctaccacagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggaactccagaagtgcttcgatgtgaaggacgtgcagatgctgcaggacgccatcagcaagatggaccccaccgacgcaaagtaccacatgcagcgctgcattgactctggcctctgggtccccaactctaaggccagcgaggccaaggagggagaggaggcaggtcctggggacccattactggaaggctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcagccccccatcagcattatccaaagggccgggggtccggggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctctctgggctgctgggagg

SEQ ID NO: 436558 - DNA, 1514 bp, Homo sapiens
  misc_feature (22)..(22): n is a, c, g, or t
  misc_feature (27)..(28): n is a, c, g, or t
  misc_feature (30)..(30): n is a, c, g, or t
  misc_feature (37)..(37): n is a, c, g, or t
aaaaagttaggctagtacgagnctggnntnaatcggncggccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaagagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggaactccagaagtgcttcgatgtgaaggacgtgcagatgctgcaggacgccatcagcaagatggaccccaccgacgcaaagtaccacatgcagcgctgcattgactctggcctctgggtccccaactctaaggccagcgaggccaaggagggagaggaggcaggtcctggggacccattactggaaggctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcagccccccatcagcattatccaaagggccgggggtccggggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctctctgggctgctgggagg

SEQ ID NO: 436559 - DNA, 449 bp, Homo sapiens
gcgctccgcagccttgccccagcccactccccctctcaccctaccacagagcatggtaaataccaagcccgagaagacggaggaggactcagaggaggtgagggagcagaaacacaagaccttcgtggaaaaatacgagaaacagatcaagcactttggtgagtggggcttgtgggttatggggggcaaggtcgaggcaggccctttgcctccagggccctccagcaccttgccagcatcttcccacaggcatgcttcgccgctgggatgacagccaaaagtacctgtcagacaacgtccacctggtgtgcgaggagacagccaattacctggtcatttggtgcattgacctagaggtggaggaggtgagtggagctttccccgggactgtgaaaaggcgctgccatgaggccgccacttggtgacgctgtgcctgttcttcctggcag

SEQ ID NO: 436560 - DNA, 2160 bp, Homo sapiens
cctccctcttgttcgtcctccctccccctgtggactgcggcgctggcgttccgcgcacgccggctcactgcgcctgcccggcgtgtggacgccacacgctcccggaagtgggaggtggccgctggagtttgtgtggccgccgccgcgggaacgcgagcccggtaatttttcaacggagaaaggcgaggctttcgggctctgcagagtgagagttagcaagtgtccggctccagcaactctcctctggcgtgacagccggcatggaggatccacagagtaaagagcctgccggcgaggccgtggctcccgcgctgctggagtcgccgcggccggagggcggggaggagccgccgcgtcccagtcccgaggaaactcaacagtgtaaatttgatggccaggagacaaaaggatccaagttcattacctccagtgcgagtgacttcagtgacccggtttacaaagagattgccattacgaatggctgtattaatagaatgagtaaggaagaactcagagctaagctttcagaattcaagcttgaaactagaggagtaaaggatgttctaaagaagagactgaaaaactattataagaagcagaagctgatgctgaaagagagcaattttgctgacagttattatgactacatttgtattattgactttgaagccacttgtgaagaaggaaacccacctgagtttgtacatgaaataattgaatttccggttgttttactgaatacgcatactttagaaatagaagacacgtttcagcagtatgtaagaccagagattaacacacagctgtctgatttctgcatcagtctaactggaattactcaggatcaggtagacagagctgataccttccctcaggtactaaaaaaagtaattgactggatgaaattgaaggaattaggaacaaagtataaatactcacttttaacagatggttcttgggatatgagtaagttcttgaacattcagtgtcaactcagcaggctcaaataccctccttttgcgaaaaagtggatcaatattcggaagtcatatggaaatttttacaaggttcctagaagccaaaccaaactgacaataatgcttgaaaaattaggaatggattatgatgggcggcctcactgtggtcttgatgactctaagaatatcgcccgaatagcagttcgaatgcttcaggatgggtgtgaactccgaatcaacgagaaaatgcatgcaggacagctaatgagtgtgtcctcttccttaccaatagagggcactccaccaccacaaatgccacattttagaaagtaacaacagttttgtgtgtggatcattccaattgaagttgctatgaagagggagaagtttctgcctggattgaaacaaaaaaacacaggcgtcacaagcatgttacctattaagagagagagggtatctctgaagactaattaaaatggtaatttttaaaaagatgtgaccagttgacttttagtatatcatcccaagtattatccccaaaatgataatgcaaaacagaataatttggagaccaggagaaaaactggtatgattactggggaggggaagaagcacaggtggtcaagataataatgcatgtttggcctcagctgtagttgccaaagaaactacctgcctcacagatgagcacgcacgggtgcattgtcaaagtctgagaaggatgtattgtactttgaaggaagactttccatttctaagctaccatggagaagtatatgctcctcgagaccagagactgtgacttctgcatctttgattccagcgacatatgataaaatgttttgcacatagttgaatccagcgttgatacatgaaggacagcattacatcttttttctattatacttagaaatttcctctttgttctgcaccaccaacctgtatatcaagcctccttgccccacaaagcttccaaagcccgtaaatttgttaatctagagcaggggtcagcaaactaccacccatgggccaaatctggcctgctgcctatttttgtatggcctacaaactatggtttttatattcccttttgttaatggctcaaaataatattttgtataatatgaaaattacgaaattttagtttctctaaataaagttttggaaagaacaaaaaatctca

SEQ ID NO: 436561 - DNA, 2278 bp, Homo sapiens
atcagtgaaccttctctactctgatgagacgcaggtccaagaaagtaattattgtttgcatctatgagttagcaaccatcagattgcatccctgaaaagcatgctaaccaggaaggcaaaaccttactaaaaacctttataaggacagtaatacatgaacaaagcaatacaagagcactgtacatctgcatacattaggaagtgaaatacgtaaactgcataaaacaaattcaattcatgttgaggcataacagaagcaacctggttgtatcaggatgtctgttccagctcataaagttcttaccagagacaactacgaaatctgtcagtgcctataagggtcatagcaaagaacagaatttgggaaagagagagtattccaaagtactgtgaattcctctcctgtaccacaagtcacttcccccaccactacacattaaacaactacctacattttctactaactaaatccttgccctaagttttccctctttaaagtattaaggaaattttttcctgtgtaaaaatatctgactttataatgaaaatcactgagaaaatgagatctactgtgcagccaattttgcagaaatataaccttcagacaagtcaggggtcctcataagagctacaagtacactgagaaggattttaagtgtgttatctgtgttctttaagttactttacttctaagaagtctatgttatataatatttcttgactacagttgactgtgccagtaaattacagggagaagtagtattacttctggacctattttctatctctaaggaaagcctttccatttttacagctaacgtgacaaaatccacttttcagccaaacttcctcaacacagcagtttagatactatttcaaatactattaaatttaacggcatgcctaaattcagacttctcatttcacttttgcacccactggaaattatttcactcaaaataattatgtcttcagatgatttcctatttccacttaaagtagaaacaaattagaacacttaaaattctatttgcacttcccaaatacagtaatgactcatttatctggcatcatcagaaaacgaggttctccacacattaagcattttccaggtaactgaagcccacaaacacagagaacttgtctgccttgttccttgctgttatccccaggacctagaacagtatccagtacgtggtagataggcagtaataattactgaatgtgtgaataaataaaagtactaaagctcttttatttttaaccatttgtgaaaatgtttcctacactgaattatagccatcccgcccttttaaaaaaacatgacactgaaaagaaataaagtttttcttattaatttgggataccactataaatagcaatcactttactcccctgcaatgtatcttagtgtctttaaagctattaaaatacactgggctttttgccaccatgtaaaaatggacacagcatggtatgctctcataacttttcctttccttatattaactgtcattgctgtgtttgctcttgctgtcttattttacacacaaaagtctggcaaggttctaaactcaattctgcctccaaagcagaataaaatacatggacttggttacaattcagaagtcttttccacttatttctgacctgtaactgcattctgattctatttatttaacaaactccttgcacacacacatcctctaccacattctacataaaatctgagatggttctattagttttaaatgagtatcttaaggattttcacttaagtgctaagtttcaaatattaatcatgagtaatgaatggctcaaagactacctccaatataaacctcagggcattttttttttttaatccattcaggagacaccagccacgacaaagctggacttcatcttgcttgataggcagtgatagggccataatttagattcacggttccaaagttcatggccaagcaaagaaaggaaaaggagcagaatgaggctgaagaaagaagctctaggtgattgggggaaaggaaagaattcactagaaatttgtttagggtccagttgatttgtgtatttttgttatcatttaatttgtaattttcgtttcagaagcaaatattcgtgttgtacaaatttctgattgccctaaatgtagagagactgatggggaaagtatgatgggtttgatttttatatcaaatcatcaggcatggagaaatatcttttagaagtgttaaaataaatgttcctactgtatatttaaaatacaaaaaaa

SEQ ID NO: 436562 - DNA, 574 bp, Homo sapiens
  misc_feature (12)..(12): n is a, c, g, or t
aagagagttagnattgggaaaattctgccatcagaaaaagctgttgtgacagaaccagcaaaaggtgaagaggccttccagatgagtgaagttgatgaggaatctggattaaaggattcagaaccagagcgaaaacgcaagaagactgaagactcttcttcaggcaaatcagtggcgtctgatgtccctgagggtgaaaaagcaatgacaaatcactgcaagagtacacgtcataagcaaaatactgagaaattcatggccaagcaaagaaaggaaaaggagcagaatgaggctgaagaaagaagctctaggtgattgggggaaaggaaagaattcactagaaatttgtttagggtccagttgatttgtgtatttttgttatcatttaatttgtaattttcgtttcagaagcaaatattcgtgttgtacaaatttctgattgccctaaatgtagagagactgatggggaaagtatgatgggtttgatttttatatcaaatcatcaggcatggagaaatatcttttagaagtgttaaaataaatgttcctactgtatatttaaaatacaaaaaaa

SEQ ID NO: 436563 - DNA, 4627 bp, Homo sapiens
cctccctcttgttcgtcctccctccccctgtggactgcggcgctggcgttccgcgcacgccggctcactgcgcctgcccggcgtgtggacgccacacgctcccggaagtgggaggtggccgctggagtttgtgtggccgccgccgcgggaacgcgagcccggtaatttttcaacggagaaaggcgaggctttcgggctctgcagagtgagagttagcaagtgtccggctccagcaactctcctctggcgtgacagccggcatggaggatccacagagtaaagagcctgccggcgaggccgtggctcccgcgctgctggagtcgccgcggccggagggcggggaggagccgccgcgtcccagtcccgaggaaactcaacagtgtaaatttgatggccaggagacaaaaggatccaagttcattacctccagtgcgagtgacttcagtgacccggtttacaaagagattgccattacgaatggctgtattaatagaatgagtaaggaagaactcagagctaagctttcagaattcaagcttgaaactagaggagtaaaggatgttctaaagaagagactgaaaaactattataagaagcagaagctgatgctgaaagagagcaattttgctgacagttattatgactacatttgtattattgactttgaagccacttgtgaagaaggaaacccacctgagtttgtacatgaaataattgaatttccggttgttttactgaatacgcatactttagaaatagaagacacgtttcagcagtatgtaagaccagagattaacacacagctgtctgatttctgcatcagtctaactggaattactcaggatcaggtagacagagctgataccttccctcaggtactaaaaaaagtaattgactggatgaaattgaaggaattaggaacaaagtataaatactcacttttaacagatggttcttgggatatgagtaagttcttgaacattcagtgtcaactcagcaggctcaaataccctccttttgcgaaaaagtggatcaatattcggaagtcatatggaaatttttacaaggttcctagaagccaaaccaaactgacaataatgcttgaaaaattaggaatggattatgatgggcggcctcactgtggtcttgatgactctaagaatatcgcccgaatagcagttcgaatgcttcaggatgggtgtgaactccgaatcaacgagaaaatgcatgcaggacagctaatgagtgtgtcctcttccttaccaatagagggcactccaccaccacaaatgccacattttagaaagtaacaacagttttgtgtgtggatcattccaattgaagttgctatgaagaggtagcagatgaatctcattgaattagtcctgtagtgcaaactttaagcaccttaaaacatttaaaatcttattacaggtgatagagatagatacatgtatgtgaacagattttgtaggaaggcatactgaattctttgtcaccagcacttttgatatgaacagtattcgttacatagtaacagttcctgcttacaactgaattttataatttaaggtgttcaagatatattctttttggttttaaaatgcaaaatcttattggctgttctgttgaatgtcatatcttactggtgtttaaatatgtaatgtgtttctttattaacatcactagatgaaaccatatcttaaaatgcagaaatgattggaaggtagatcttatctagcctttggatttcaagaatatcatagtccttttgattttcaaagtttatatgtgaagttcaccatgtatgtggtgaatttcgtaaggtacttggtatacatatctgcctatgtttcttttcaactcataattggaagaattatgatggattatagggtttggttaaaaatccagttactgaaggaattaatgaaaacgtagaagaaagtactaaaaggaatatcataagggctgtagctcaaacttcataatacataaatcactggggtctttttggatttggttgtttgattcgccttccttttttgacatatgtatgccttaattcttaaatctgagggaccatgctttgaaatagactgaaaattaagggtcaccacctaattttactttgtattcagtatcgtaagtgaggttaataaagtcaatactttctaccatatattacgtttttgttattaaaaaacttcattggccactagtgaagttagtcaataaaagacttgtttttctgattttacatagtaaatggctgctaagtattgagtaattcttaactaattctaaaaactaaaatgtgcatttcgacttgataaggtaaaactcttatctagaggctaaacccatgtattttcagaattgaatttttctccttgtagctttcagggaacaatttcattgacattgcttgcttcctgccttttaccttttaataaaaattgtgatgctactttattctaaagatttatattttataaccagatgaatttcctcaaaggtttccaaacctatatcatatagggtgaaaagcaggaaagtagacatttttcttggcgtgggaattctctacatagggcagtagatttcttaagccaatgaatttctgcttttcagcagtagtcatataatcagtatcataaagaataatgtgtaaataacagaaggcatatgagagtgtggtgttcctagatgaactgttacagattatagtaaaataaggaaatctaagtgctttaagtttatacagttaactcttaggataagagggatgtatgctgagatgtttgtgcatcccagatagcactgtacgataacctgtaaagtattactgaatactgaatagctgaaactgcaattggaaaatctgatgatgacgaggaaatattacgtttccagtttttttagctctatctgctaatttctttgcctgttttcactttcgccaagtaccaacaagctcatgttgtatttctttttaagaacttcaacattataagctctcagtaccctattttgttgttgttgttgtttgagacagagtttttgctcgtctgccaggatggagtgcagtggtgcgatcttggctcactgcaacctccgcctcctgggctcaggtgatcctcttgcctcagcctcctgagtagctcagattacaggcgcgtgccaccacacccgcctaatttttgtatttttggtagaggcggggtttcaccatgttggtcaggctggtcttgaactcctgacctcaagtgatttgcccaccttgacctcctacagacgtgagccactgcgctcagccatagattttactgtcttaacccattttaattcctctgttgagtctctgtcctcccctccaatttgatttgggattttgctgatgagatgatactaaacattgagagtactgctttttactctgacttttattgtgttgtctttgaaagacaaatagtacaactttttacaaggaaacacgtaagagatggatgtccatgaaaacaatattagtatattctattattgtttcttattaatagttacttagtatttacaaacaatttattattagctgtgttaacttttattctatgcttcatatgctctgacattgacatagtggatttctgctgatttttttcaaatccgcaatctttataaccaactgaagtatataatagagcattacattttatctttatttgtgttctgttggatcaagtatttaacatttgctctgaaaaaaatgtttttgtgatgtgtctttgttgccttgagatagatccatttatcctgcctcctagggagaagtttctgcctggattgaaacaaaaaaacacaggcgtcacaagcatgttacctattaagagagagagggtatctctgaagactaattaaaatggtaatttttaaaaagatgtgaccagttgacttttagtatatcatcccaagtattatccccaaaatgataatgcaaaacagaataatttggagaccaggagaaaaactggtatgattactggggaggggaagaagcacaggtggtcaagataataatgcatgtttggcctcagctgtagttgccaaagaaactacctgcctcacagatgagcacgcacgggtgcattgtcaaagtctgagaaggatgtattgtactttgaaggaagactttccatttctaagctaccatggagaagtatatgctcctcgagaccagagactgtgacttctgcatctttgattccagcgacatatgataaaatgttttgcacatagttgaatccagcgttgatacatgaaggacagcattacatcttttttctattatacttagaaatttcctctttgttctgcaccaccaacctgtatatcaagcctccttgccccacaaagcttccaaagcccgtaaatttgttaatctagagcaggggtcagcaaactaccacccatgggccaaatctggcctgctgcctatttttgtatggcctacaaactatggtttttatattcccttttgttaatggctcaaaataatattttgtataatatgaaaattacgaaattttagtttctctaaataaagttttggaaagaacaaaaaatctca

SEQ ID NO: 436564 - DNA, 4734 bp, Homo sapiens
cctccctcttgttcgtcctccctccccctgtggactgcggcgctggcgttccgcgcacgccggctcactgcgcctgcccggcgtgtggacgccacacgctcccggaagtgggaggtggccgctggagtttgtgtggccgccgccgcgggaacgcgagcccggtaatttttcaacggagaaaggcgaggctttcgggctctgcagagtgagagttagcaagtgtccggctccagcaactctcctctggcgtgacagccggcatggaggatccacagagtaaagagcctgccggcgaggccgtggctcccgcgctgctggagtcgccgcggccggagggcggggaggagccgccgcgtcccagtcccgaggaaactcaacagtgtaaatttgatggccaggagacaaaaggatccaagttcattacctccagtgcgagtgacttcagtgacccggtttacaaagagattgccattacgaatggctgtattaatagaatgagtaaggaagaactcagagctaagctttcagaattcaagcttgaaactaggtacaacttgtagcctacagaagattttccgagcaaaatttttgtccttcccaggtgtgaagatcagttgcttactcctggcttgcgtgggagctagcgatctagataggagtaaaggatgttctaaagaagagactgaaaaactattataagaagcagaagctgatgctgaaagagagcaattttgctgacagttattatgactacatttgtattattgactttgaagccacttgtgaagaaggaaacccacctgagtttgtacatgaaataattgaatttccggttgttttactgaatacgcatactttagaaatagaagacacgtttcagcagtatgtaagaccagagattaacacacagctgtctgatttctgcatcagtctaactggaattactcaggatcaggtagacagagctgataccttccctcaggtactaaaaaaagtaattgactggatgaaattgaaggaattaggaacaaagtataaatactcacttttaacagatggttcttgggatatgagtaagttcttgaacattcagtgtcaactcagcaggctcaaataccctccttttgcgaaaaagtggatcaatattcggaagtcatatggaaatttttacaaggttcctagaagccaaaccaaactgacaataatgcttgaaaaattaggaatggattatgatgggcggcctcactgtggtcttgatgactctaagaatatcgcccgaatagcagttcgaatgcttcaggatgggtgtgaactccgaatcaacgagaaaatgcatgcaggacagctaatgagtgtgtcctcttccttaccaatagagggcactccaccaccacaaatgccacattttagaaagtaacaacagttttgtgtgtggatcattccaattgaagttgctatgaagaggtagcagatgaatctcattgaattagtcctgtagtgcaaactttaagcaccttaaaacatttaaaatcttattacaggtgatagagatagatacatgtatgtgaacagattttgtaggaaggcatactgaattctttgtcaccagcacttttgatatgaacagtattcgttacatagtaacagttcctgcttacaactgaattttataatttaaggtgttcaagatatattctttttggttttaaaatgcaaaatcttattggctgttctgttgaatgtcatatcttactggtgtttaaatatgtaatgtgtttctttattaacatcactagatgaaaccatatcttaaaatgcagaaatgattggaaggtagatcttatctagcctttggatttcaagaatatcatagtccttttgattttcaaagtttatatgtgaagttcaccatgtatgtggtgaatttcgtaaggtacttggtatacatatctgcctatgtttcttttcaactcataattggaagaattatgatggattatagggtttggttaaaaatccagttactgaaggaattaatgaaaacgtagaagaaagtactaaaaggaatatcataagggctgtagctcaaacttcataatacataaatcactggggtctttttggatttggttgtttgattcgccttccttttttgacatatgtatgccttaattcttaaatctgagggaccatgctttgaaatagactgaaaattaagggtcaccacctaattttactttgtattcagtatcgtaagtgaggttaataaagtcaatactttctaccatatattacgtttttgttattaaaaaacttcattggccactagtgaagttagtcaataaaagacttgtttttctgattttacatagtaaatggctgctaagtattgagtaattcttaactaattctaaaaactaaaatgtgcatttcgacttgataaggtaaaactcttatctagaggctaaacccatgtattttcagaattgaatttttctccttgtagctttcagggaacaatttcattgacattgcttgcttcctgccttttaccttttaataaaaattgtgatgctactttattctaaagatttatattttataaccagatgaatttcctcaaaggtttccaaacctatatcatatagggtgaaaagcaggaaagtagacatttttcttggcgtgggaattctctacatagggcagtagatttcttaagccaatgaatttctgcttttcagcagtagtcatataatcagtatcataaagaataatgtgtaaataacagaaggcatatgagagtgtggtgttcctagatgaactgttacagattatagtaaaataaggaaatctaagtgctttaagtttatacagttaactcttaggataagagggatgtatgctgagatgtttgtgcatcccagatagcactgtacgataacctgtaaagtattactgaatactgaatagctgaaactgcaattggaaaatctgatgatgacgaggaaatattacgtttccagtttttttagctctatctgctaatttctttgcctgttttcactttcgccaagtaccaacaagctcatgttgtatttctttttaagaacttcaacattataagctctcagtaccctattttgttgttgttgttgtttgagacagagtttttgctcgtctgccaggatggagtgcagtggtgcgatcttggctcactgcaacctccgcctcctgggctcaggtgatcctcttgcctcagcctcctgagtagctcagattacaggcgcgtgccaccacacccgcctaatttttgtatttttggtagaggcggggtttcaccatgttggtcaggctggtcttgaactcctgacctcaagtgatttgcccaccttgacctcctacagacgtgagccactgcgctcagccatagattttactgtcttaacccattttaattcctctgttgagtctctgtcctcccctccaatttgatttgggattttgctgatgagatgatactaaacattgagagtactgctttttactctgacttttattgtgttgtctttgaaagacaaatagtacaactttttacaaggaaacacgtaagagatggatgtccatgaaaacaatattagtatattctattattgtttcttattaatagttacttagtatttacaaacaatttattattagctgtgttaacttttattctatgcttcatatgctctgacattgacatagtggatttctgctgatttttttcaaatccgcaatctttataaccaactgaagtatataatagagcattacattttatctttatttgtgttctgttggatcaagtatttaacatttgctctgaaaaaaatgtttttgtgatgtgtctttgttgccttgagatagatccatttatcctgcctcctagggagaagtttctgcctggattgaaacaaaaaaacacaggcgtcacaagcatgttacctattaagagagagagggtatctctgaagactaattaaaatggtaatttttaaaaagatgtgaccagttgacttttagtatatcatcccaagtattatccccaaaatgataatgcaaaacagaataatttggagaccaggagaaaaactggtatgattactggggaggggaagaagcacaggtggtcaagataataatgcatgtttggcctcagctgtagttgccaaagaaactacctgcctcacagatgagcacgcacgggtgcattgtcaaagtctgagaaggatgtattgtactttgaaggaagactttccatttctaagctaccatggagaagtatatgctcctcgagaccagagactgtgacttctgcatctttgattccagcgacatatgataaaatgttttgcacatagttgaatccagcgttgatacatgaaggacagcattacatcttttttctattatacttagaaatttcctctttgttctgcaccaccaacctgtatatcaagcctccttgccccacaaagcttccaaagcccgtaaatttgttaatctagagcaggggtcagcaaactaccacccatgggccaaatctggcctgctgcctatttttgtatggcctacaaactatggtttttatattcccttttgttaatggctcaaaataatattttgtataatatgaaaattacgaaattttagtttctctaaataaagttttggaaagaacaaaaaatctca

SEQ ID NO: 436565 - DNA, 4419 bp, Homo sapiens
tcaacattactgtagatacacagtgttagcaactcttaaactacctatatatcatacagttaaattttgactatttagaatttagttcaattggatttttatatgaaaataaagactattcaggagtaaatgagagaaaaatagtttaaagctaatttattataactgcaggctggcatttcttcaaaagaatttattatttttaaaacttagtatcttgaagtagaggatgcattaatgcgctttatagttttaaaatattatgaacaaaattattaatattttgttcctcaggaaaataattaaattttgggttgaaatctttcacacactcactttatcgtaaaatattttaaattatgaatcaattcattttttaatttaaaaattaagagtgctttcgatgtggggaattattcttaaaaactggaagggtttatgccgtgagatcctatgaaattgcaacctgctgtgatgaattcgtcgtgtatcatgtatcgtgtatcttaactcatataaattactttaacttgctatccttcccttgcaggaagacacgtttcagcagtatgtaagaccagagattaacacacagctgtctgatttctgcatcagtctaactggaattactcaggatcaggtagacagagctgataccttccctcaggtactaaaaaaagtaattgactggatgaaattgaaggaattaggaacaaagtataaatactcacttttaacagatggttcttgggatatgagtaagttcttgaacattcagtgtcaactcagcaggctcaaataccctccttttgcgaaaaagtggatcaatattcggaagtcatatggaaatttttacaaggttcctagaagccaaaccaaactgacaataatgcttgaaaaattaggaatggattatgatgggcggcctcactgtggtcttgatgactctaagaatatcgcccgaatagcagttcgaatgcttcaggatgggtgtgaactccgaatcaacgagaaaatgcatgcaggacagctaatgagtgtgtcctcttccttaccaatagagggcactccaccaccacaaatgccacattttagaaagtaacaacagttttgtgtgtggatcattccaattgaagttgctatgaagaggtagcagatgaatctcattgaattagtcctgtagtgcaaactttaagcaccttaaaacatttaaaatcttattacaggtgatagagatagatacatgtatgtgaacagattttgtaggaaggcatactgaattctttgtcaccagcacttttgatatgaacagtattcgttacatagtaacagttcctgcttacaactgaattttataatttaaggtgttcaagatatattctttttggttttaaaatgcaaaatcttattggctgttctgttgaatgtcatatcttactggtgtttaaatatgtaatgtgtttctttattaacatcactagatgaaaccatatcttaaaatgcagaaatgattggaaggtagatcttatctagcctttggatttcaagaatatcatagtccttttgattttcaaagtttatatgtgaagttcaccatgtatgtggtgaatttcgtaaggtacttggtatacatatctgcctatgtttcttttcaactcataattggaagaattatgatggattatagggtttggttaaaaatccagttactgaaggaattaatgaaaacgtagaagaaagtactaaaaggaatatcataagggctgtagctcaaacttcataatacataaatcactggggtctttttggatttggttgtttgattcgccttccttttttgacatatgtatgccttaattcttaaatctgagggaccatgctttgaaatagactgaaaattaagggtcaccacctaattttactttgtattcagtatcgtaagtgaggttaataaagtcaatactttctaccatatattacgtttttgttattaaaaaacttcattggccactagtgaagttagtcaataaaagacttgtttttctgattttacatagtaaatggctgctaagtattgagtaattcttaactaattctaaaaactaaaatgtgcatttcgacttgataaggtaaaactcttatctagaggctaaacccatgtattttcagaattgaatttttctccttgtagctttcagggaacaatttcattgacattgcttgcttcctgccttttaccttttaataaaaattgtgatgctactttattctaaagatttatattttataaccagatgaatttcctcaaaggtttccaaacctatatcatatagggtgaaaagcaggaaagtagacatttttcttggcgtgggaattctctacatagggcagtagatttcttaagccaatgaatttctgcttttcagcagtagtcatataatcagtatcataaagaataatgtgtaaataacagaaggcatatgagagtgtggtgttcctagatgaactgttacagattatagtaaaataaggaaatctaagtgctttaagtttatacagttaactcttaggataagagggatgtatgctgagatgtttgtgcatcccagatagcactgtacgataacctgtaaagtattactgaatactgaatagctgaaactgcaattggaaaatctgatgatgacgaggaaatattacgtttccagtttttttagctctatctgctaatttctttgcctgttttcactttcgccaagtaccaacaagctcatgttgtatttctttttaagaacttcaacattataagctctcagtaccctattttgttgttgttgttgtttgagacagagtttttgctcgtctgccaggatggagtgcagtggtgcgatcttggctcactgcaacctccgcctcctgggctcaggtgatcctcttgcctcagcctcctgagtagctcagattacaggcgcgtgccaccacacccgcctaatttttgtatttttggtagaggcggggtttcaccatgttggtcaggctggtcttgaactcctgacctcaagtgatttgcccaccttgacctcctacagacgtgagccactgcgctcagccatagattttactgtcttaacccattttaattcctctgttgagtctctgtcctcccctccaatttgatttgggattttgctgatgagatgatactaaacattgagagtactgctttttactctgacttttattgtgttgtctttgaaagacaaatagtacaactttttacaaggaaacacgtaagagatggatgtccatgaaaacaatattagtatattctattattgtttcttattaatagttacttagtatttacaaacaatttattattagctgtgttaacttttattctatgcttcatatgctctgacattgacatagtggatttctgctgatttttttcaaatccgcaatctttataaccaactgaagtatataatagagcattacattttatctttatttgtgttctgttggatcaagtatttaacatttgctctgaaaaaaatgtttttgtgatgtgtctttgttgccttgagatagatccatttatcctgcctcctagggagaagtttctgcctggattgaaacaaaaaaacacaggcgtcacaagcatgttacctattaagagagagagggtatctctgaagactaattaaaatggtaatttttaaaaagatgtgaccagttgacttttagtatatcatcccaagtattatccccaaaatgataatgcaaaacagaataatttggagaccaggagaaaaactggtatgattactggggaggggaagaagcacaggtggtcaagataataatgcatgtttggcctcagctgtagttgccaaagaaactacctgcctcacagatgagcacgcacgggtgcattgtcaaagtctgagaaggatgtattgtactttgaaggaagactttccatttctaagctaccatggagaagtatatgctcctcgagaccagagactgtgacttctgcatctttgattccagcgacatatgataaaatgttttgcacatagttgaatccagcgttgatacatgaaggacagcattacatcttttttctattatacttagaaatttcctctttgttctgcaccaccaacctgtatatcaagcctccttgccccacaaagcttccaaagcccgtaaatttgttaatctagagcaggggtcagcaaactaccacccatgggccaaatctggcctgctgcctatttttgtatggcctacaaactatggtttttatattcccttttgttaatggctcaaaataatattttgtataatatgaaaattacgaaattttagtttctctaaataaagttttggaaagaacaaaaaatctca

SEQ ID NO: 436566 - DNA, 3867 bp, Homo sapiens
agagtgattaccccccaaacccccacccaatagggtttagaagcttaaataccacctaaaggttacagaaagagtgtgggctcggatcagtggcataacatgttcggggagctggagaaggggaagcctggctagcaaaggtggcctgaattttttatatgccttatttgagtgggggtattgccctttgcctagctttatttagctgttagtgctaattttcagtttcttatttttcatcttaactgtggcttatattacagtttagaacaccaaagaattatttactaagctgtttatttttcaggttcctagaagccaaaccaaactgacaataatgcttgaaaaattaggaatggattatgatgggcggcctcactgtggtcttgatgactctaagaatatcgcccgaatagcagttcgaatgcttcaggatgggtgtgaactccgaatcaacgagaaaatgcatgcaggacagctaatgagtgtgtcctcttccttaccaatagagggcactccaccaccacaaatgccacattttagaaagtaacaacagttttgtgtgtggatcattccaattgaagttgctatgaagaggtagcagatgaatctcattgaattagtcctgtagtgcaaactttaagcaccttaaaacatttaaaatcttattacaggtgatagagatagatacatgtatgtgaacagattttgtaggaaggcatactgaattctttgtcaccagcacttttgatatgaacagtattcgttacatagtaacagttcctgcttacaactgaattttataatttaaggtgttcaagatatattctttttggttttaaaatgcaaaatcttattggctgttctgttgaatgtcatatcttactggtgtttaaatatgtaatgtgtttctttattaacatcactagatgaaaccatatcttaaaatgcagaaatgattggaaggtagatcttatctagcctttggatttcaagaatatcatagtccttttgattttcaaagtttatatgtgaagttcaccatgtatgtggtgaatttcgtaaggtacttggtatacatatctgcctatgtttcttttcaactcataattggaagaattatgatggattatagggtttggttaaaaatccagttactgaaggaattaatgaaaacgtagaagaaagtactaaaaggaatatcataagggctgtagctcaaacttcataatacataaatcactggggtctttttggatttggttgtttgattcgccttccttttttgacatatgtatgccttaattcttaaatctgagggaccatgctttgaaatagactgaaaattaagggtcaccacctaattttactttgtattcagtatcgtaagtgaggttaataaagtcaatactttctaccatatattacgtttttgttattaaaaaacttcattggccactagtgaagttagtcaataaaagacttgtttttctgattttacatagtaaatggctgctaagtattgagtaattcttaactaattctaaaaactaaaatgtgcatttcgacttgataaggtaaaactcttatctagaggctaaacccatgtattttcagaattgaatttttctccttgtagctttcagggaacaatttcattgacattgcttgcttcctgccttttaccttttaataaaaattgtgatgctactttattctaaagatttatattttataaccagatgaatttcctcaaaggtttccaaacctatatcatatagggtgaaaagcaggaaagtagacatttttcttggcgtgggaattctctacatagggcagtagatttcttaagccaatgaatttctgcttttcagcagtagtcatataatcagtatcataaagaataatgtgtaaataacagaaggcatatgagagtgtggtgttcctagatgaactgttacagattatagtaaaataaggaaatctaagtgctttaagtttatacagttaactcttaggataagagggatgtatgctgagatgtttgtgcatcccagatagcactgtacgataacctgtaaagtattactgaatactgaatagctgaaactgcaattggaaaatctgatgatgacgaggaaatattacgtttccagtttttttagctctatctgctaatttctttgcctgttttcactttcgccaagtaccaacaagctcatgttgtatttctttttaagaacttcaacattataagctctcagtaccctattttgttgttgttgttgtttgagacagagtttttgctcgtctgccaggatggagtgcagtggtgcgatcttggctcactgcaacctccgcctcctgggctcaggtgatcctcttgcctcagcctcctgagtagctcagattacaggcgcgtgccaccacacccgcctaatttttgtatttttggtagaggcggggtttcaccatgttggtcaggctggtcttgaactcctgacctcaagtgatttgcccaccttgacctcctacagacgtgagccactgcgctcagccatagattttactgtcttaacccattttaattcctctgttgagtctctgtcctcccctccaatttgatttgggattttgctgatgagatgatactaaacattgagagtactgctttttactctgacttttattgtgttgtctttgaaagacaaatagtacaactttttacaaggaaacacgtaagagatggatgtccatgaaaacaatattagtatattctattattgtttcttattaatagttacttagtatttacaaacaatttattattagctgtgttaacttttattctatgcttcatatgctctgacattgacatagtggatttctgctgatttttttcaaatccgcaatctttataaccaactgaagtatataatagagcattacattttatctttatttgtgttctgttggatcaagtatttaacatttgctctgaaaaaaatgtttttgtgatgtgtctttgttgccttgagatagatccatttatcctgcctcctagggagaagtttctgcctggattgaaacaaaaaaacacaggcgtcacaagcatgttacctattaagagagagagggtatctctgaagactaattaaaatggtaatttttaaaaagatgtgaccagttgacttttagtatatcatcccaagtattatccccaaaatgataatgcaaaacagaataatttggagaccaggagaaaaactggtatgattactggggaggggaagaagcacaggtggtcaagataataatgcatgtttggcctcagctgtagttgccaaagaaactacctgcctcacagatgagcacgcacgggtgcattgtcaaagtctgagaaggatgtattgtactttgaaggaagactttccatttctaagctaccatggagaagtatatgctcctcgagaccagagactgtgacttctgcatctttgattccagcgacatatgataaaatgttttgcacatagttgaatccagcgttgatacatgaaggacagcattacatcttttttctattatacttagaaatttcctctttgttctgcaccaccaacctgtatatcaagcctccttgccccacaaagcttccaaagcccgtaaatttgttaatctagagcaggggtcagcaaactaccacccatgggccaaatctggcctgctgcctatttttgtatggcctacaaactatggtttttatattcccttttgttaatggctcaaaataatattttgtataatatgaaaattacgaaattttagtttctctaaataaagttttggaaagaacaaaaaatctca

SEQ ID NO: 436567 - DNA, 1700 bp, Homo sapiens
cctccctcttgttcgtcctccctccccctgtggactgcggcgctggcgttccgcgcacgccggctcactgcgcctgcccggcgtgtggacgccacacgctcccggaagtgggaggtggccgctggagtttgtgtggccgccgccgcgggaacgcgagcccggtaatttttcaacggagaaaggcgaggctttcgggctctgcagagtgagagttagcaagtgtccggctccagcaactctcctctggcgtgacagccggcatggaggatccacagagtaaagagcctgccggcgaggccgtggctcccgcgctgctggagtcgccgcggccggagggcggggaggagccgccgcgtcccagtcccgaggaaactcaacagtgtaaatttgatggccaggagacaaaaggatccaagttcattacctccagtgcgagtgacttcagtgacccggtttacaaagagattgccattacgaatggctgtattaatagaatgagtaaggaagaactcagagctaagctttcagaattcaagcttgaaactagaggagtaaaggatgttctaaagaagagactgaaaaactattataagaagcagaagctgatgctgaaagagagcaattttgctgacagttattatgactacatttgtattattgactttgaagccacttgtgaagaaggaaacccacctgagtttgtacatgaaataattgaatttccggttgttttactgaatacgcatactttagaaatagaagacacgtttcagcagtatgtaagaccagagattaacacacagctgtctgatttctgcatcagtctaactggaattactcaggatcaggtagacagagctgataccttccctcaggtactaaaaaaagtaattgactggatgaaattgaaggaattaggaacaaagtataaatactcacttttaacagatggttcttgggatatgagtaagttcttgaacattcagtgtcaactcagcaggctcaaataccctccttttgcgaaaaagtggatcaatattcggaagtcatatggaaatttttacaagagaaagaggaaaggaccaggagtggcgaccggcaaaccacagcttgtgtgggaaggaaatttgacatgtgatgcaagcggacgtttgtgtaaactgctgggagattaacaacgggatctcactctgtcacccaggctggaattgcatgatcatggctcactgcagcctcagacttttgggctcaagcaatgctcccgcctcagcctcccaaaatgctggattacaggcacaactgtgagtggaattgctgagtcatgtggcaaactaccagttctgttgaacctcagggccatcattctgttcatgtcagctcgttgtagaaccacatcgatgaagaccaagatggtaaagatgaaaaattgtagctaacatttactgcacatttactacaagccaagcattgcactatgaagtttaagtgcattattcattaaccccttcaataaaatttgtaattttcgtttcagaagcaaatattcgtgttgtacaaatttctgattgccctaaatgtagagagactgatggggaaagtatgatgggtttgatttttatatcaaatcatcaggcatggagaaatatcttttagaagtgttaaaataaatgttcctactgtatatttaaaatacaaaaaaa

SEQ ID NO: 436568 - DNA, 637 bp, Homo sapiens
  misc_feature (12)..(12): n is a, c, g, or t
aagagagttagnattgggaaaattctgccatcagaaaaagctgttgtgacagaaccagcaaaaggtgaagaggccttccagatgagtgaagttgatgaggaatctggattaaaggattcagaaccagagcgaaaacgcaagaagactgaagactcttcttcaggcaaatcagtggcgtctgatgtccctgaggaattagactttcttgtacctaaggctggattcttctgtccaatttgttccctcttctactcaggtgaaaaagcaatgacaaatcactgcaagagtacacgtcataagcaaaatactgagaaattcatggccaagcaaagaaaggaaaaggagcagaatgaggctgaagaaagaagctctaggtgattgggggaaaggaaagaattcactagaaatttgtttagggtccagttgatttgtgtatttttgttatcatttaatttgtaattttcgtttcagaagcaaatattcgtgttgtacaaatttctgattgccctaaatgtagagagactgatggggaaagtatgatgggtttgatttttatatcaaatcatcaggcatggagaaatatcttttagaagtgttaaaataaatgttcctactgtatatttaaaatacaaaaaaa

SEQ ID NO: 436569 - DNA, 723 bp, Homo sapiens
cctccctcttgttcgtcctccctccccctgtggactgcggcgctggcgttccgcgcacgccggctcactgcgcctgcccggcgtgtggacgccacacgctcccggaagtgggaggtggccgctggagtttgtgtggccgccgccgcgggaacgcgagcccggtaatttttcaacggagaaaggcgaggctttcgggctctgcagagtgagagttagcaagtgtccggctccagcaactctcctctggcgtgacagccggcatggaggatccacagagtaaagagcctgccggcgaggccgtggctcccgcgctgctggagtcgccgcggccggagggcggggaggagccgccgcgtcccagtcccgaggaaactcaacagtgtaaatttgatggccaggagacaaaagagattgccattacgaatggctgtattaatagaatgagtaaggaagaactcagagctaagctttcagaattcaagcttgaaactagaggagtaaaggatgttctaaagaagagactgaaaaactattataagaagcagaagctgatgctgaaagagagcaattttgctgacagttattatgactacatttgtattattgactttgaagccacttgtgaagaaggaaacccacctgagtttgtacatgaaataattgaatttccggttgttttactgaatacgcatactttagaaatagtaagtgaatttttgtatt

SEQ ID NO: 436570 - DNA, 1467 bp, Homo sapiens
cctccctcttgttcgtcctccctccccctgtggactgcggcgctggcgttccgcgcacgccggctcactgcgcctgcccggcgtgtggacgccacacgctcccggaagtgggaggtggccgctggagtttgtgtggccgccgccgcgggaacgcgagcccggtaatttttcaacggagaaaggcgaggctttcgggctctgcagagtgagagttagcaagtgtccggctccagcaactctcctctggcgtgacagccggcatggaggatccacagagtaaagagcctgccggcgaggccgtggctcccgcgctgctggagtcgccgcggccggagggcggggaggagccgccgcgtcccagtcccgaggaaactcaacagtgtaaatttgatggccaggagacaaaaggatccaagttcattacctccagtgcgagtgacttcagtgacccggtttacaaagagattgccattacgaatggctgtattaatagaatgagtaaggaagaactcagagctaagctttcagaattcaagcttgaaactagaggagtaaaggatgttctaaagaagagactgaaaaactattataagaagcagaagctgatgctgaaagagagcaattttgctgacagttattatgactacatttgtattattgactttgaagccacttgtgaagaaggaaacccacctgagtttgtacatgaaataattgaatttccggttgttttactgaatacgcatactttagaaatagaagacacgtttcagcagtatgtaagaccagagattaacacacagctgtctgatttctgcatcagtctaactggaattactcaggatcaggtagacagagctgataccttccctcaggtactaaaaaaagtaattgactggatgaaattgaaggaattaggaacaaagtataaatactcacttttaacagatggttcttgggatatgagtaagttcttgaacattcagtgtcaactcagcaggctcaaataccctccttttgcgaaaaagtggatcaatattcggaagtcatatggaaatttttacaagggggaacatccgcatccaagagacgcctgcagtccagggggctccagagggagggagtcctgtggatgtggaagatacgcttttgtctgagagtcatgagattggactgtgggtccctgttgttgttaacccctgtgtgatcttgggcaattcactgttcctgtctttacctctacttgctcctcagtaagtcagagtgaactgagatctcttcctgaaattacttagcctaattctatggttggtttctggtggccaggaaccagaaataaatctctcagcaaaattttgcttatggaccatgaatcttagagtatccatggtatcactgatatctttaattcccagatattttccagtaatgaaattcatataataaagccaggatctctggttctta

SEQ ID NO: 436571 - DNA, 481 bp, Homo sapiens
tgccggcgaggccgtggctcccgcgctgctggagtcgccgcggccggagggcggggaggagccgccgcgtcccagtcccgaggtgaggagtcgacccgcgcctggctgttggcgccagctgccccgtccccaaagcgccctcggcacccctttcttctcaggtgtcccgcagaaggtgcagctgtgcgcccttggaccccagcctcttcctcggtgcccagctccctggctttatcctcgggtgggtgtcttggagccccctcagggccgaatcactctctgggagggaggaaatcgtcaagaccagttctgtctacagtgggttaacaggttctaagagggagttttgctttaaacttaattctgtgttcacggttgctgttgtcactccatgtagccgttatgggtagtttgcaaggctttatgtttttaaaatctcaccatatacgctaggtatgtcacttcatgcctgtttttaaaa

SEQ ID NO: 436572 - DNA, 4143 bp, Homo sapiens
gggggcccgctgcagggagaacggactccgggcggagggcagccaatccgtttcagcgcaggtcttgctcgggttgggcttgccactgcctggaacatacctgtccccctggcgcaacactcagctggctgcgaccgcaaccccgagcctggacactgcgccaggaatcctaaaaccaaaatattagaacgaaaacagaaacatggctcactatattacatttctctgcatggttttggtgctgcttcttcagaattctgtgttagctgaagatggggaagtaagatcaagttgtcgtactgctccgacagatttagttttcatcttagatggctcttatagtgttggcccagaaaactttgaaatagtgaaaaagtggcttgtcaatatcacaaaaaactttgacatagggccgaagtttattcaagttggagtggttcaatatagtgactaccctgtgctggagattcctctcggaagctatgattcaggagaacatttgacggcagcagtggaatccatactctacttaggaggaaacacaaagacagggaaggccatccagtttgcgctcgattacctttttgccaagtcctcacgatttctgactaagatagcagtggtacttacggatggcaagtcccaagatgacgtcaaggatgcagctcaagcagcaagagatagtaagataacattatttgctattggtgttggttcagaaacagaagatgccgaacttagagctattgccaacaagccttcgtctacttatgtgttttatgtggaagactatattgcaatatccaaaataagggaagtgatgaagcagaaactttgtgaagaatctgtctgtccaacacgaattccagtggcagctcgtgatgaaaggggatttgatattcttttgggtttagatgtaaataaaaaggttaagaaaagaatacagctttcaccaaaaaagataaaaggatatgaagtaacatcaaaagttgatttatcagaactcacaagcaatgttttcccagaaggtcttcctccatcatatgtatttgtgtctactcaaagatttaaagtcaagaaaatttgggatttatggagaatattaactattgatggaaggccacaaatagcagttaccttaaatggtgtggacaaaatcttattatttacaacaaccagcgtaattaatggctcacaagtggttacctttgctaaccctcaagttaagacgttgtttgatgaaggctggcaccaaattcgtctcttagtaacagaacaagatgtgactttgtatattgatgaccaacaaattgaaaacaagcccttacatccagttttagggatcttgatcaatgggcaaacccaaattggaaaatattctggaaaagaagaaactgttcagtttgatgtccaaaagttgcgaatctactgtgacccagaacagaacaaccgggagacagcatgtgagattcctggatttaatggagagtgccttaatggtcccagtgatgtaggttcaactccagctccctgtatttgtcctccgggaaaaccaggacttcaaggccccaaaggtgaccctggactgcctgggaaccctggctaccctggacaacctggtcaagatggtaagcctggatatcagggaattgcagggacaccaggtgttccaggatctccaggaatacaaggagctcgaggactaccaggttacaaaggagaaccagggcgagatggtgacaagggtgatcgtggacttcctggttttcctgggcttcatggcatgccaggatcaaagggtgaaatgggtgccaaaggagacaaaggatcacctggattttatggcaaaaagggtgcaaaaggtgaaaaggggaatgctggcttccctggcctccctggacctgctggagaaccaggaagacatggaaaggatggattaatgggtagtcccggtttcaagggagaagcaggatcccctggtgctccggggcaggatggaacacggggagagcctggaatcccaggatttcctggaaaccgaggattaatgggccaaaagggagaaattgggcctccaggacagcaaggaaaaaaaggagccccagggatgcctggtttaatgggaagcaatggctcaccaggccagcctggaacaccgggatctaagggaagcaaaggtgaacctggaattcaagggatgcctggggcttcagggctcaagggagaaccaggagcaacgggttccccaggagaaccaggatacatgggtttacccgggattcaaggaaaaaagggggacaaaggaaatcaaggtgaaaaaggtattcagggtcaaaagggagaaaatggaagacagggaattccagggcaacagggaattcaaggccatcatggtgcaaaaggagagagaggtgaaaagggagaacctggtgtccgaggtgccattggatcaaaaggagaatctggggtggatggcttgatggggcccgcaggtcctaaggggcaacctggggatccaggtcctcagggacccccaggtttggatgggaagcccggaagagagttttcagaacaatttattcgacaagtttgcacagatgtaataagagcccagctaccagtcttacttcagagtggaagaattagaaattgtgatcattgcctgtcccaacatggctccccgggtattcctgggccacctggtccgataggcccagagggtcccagaggattacctggtttgccaggaagagatggtgttcctggattagtgggtgtccctggacgtccaggtgtcagaggattaaaaggcctaccaggaagaaatggggaaaaagggagccaagggtttgggtatcctggagaacaaggtcctcctggtcccccaggtccagagggccctcctggaataagcaaagaaggtcctccaggagacccaggtctccctggcaaagatggagaccatggaaaacctggaatccaagggcaaccaggccccccaggcatctgcgacccatcactatgttttagtgtaattgccagaagagatccgttcagaaaaggaccaaactattagtgtctgatgcctcattcagcagcctaggcatggtgctttttctgtggtcttttgcatctcaggaagataaccaacagtaatcccttgaaaagaaacttaagtacctcggtgtttttattttttttttcttatggaaaaaaatataaaagatcacatatactgattttaaaggctcctcagtcatttggagcccttggattagcagcattaattaaatctcaagggtttcttgtaaagtccatttatgttaatcaaagttgaatataaaaatccaccattgcctgttagccagtcagttttagtcactgtgaaatatttcacattcagcctccatgcagtagagatttgagtttaatttcatgtccatgtgactttcatgtttcctatctcatagctcatgctactacataagccaaaacatgtatctcatcattggaagtaagatcagggctgatattcacctgggatagacagtattggtgaactactcatttactacagtgtctcagccttgataaagggcagtggattgcctgttgttcggtgttgtgaatagcacctctgaataagattagagtgtttcttaattcatttcaaactctaaaattagattaatggtggtgctaagaaagagtattaattactttgggaatggtcaaaattaacattaaaaacattttagacaaaaagtttcattgtacattcaaagaaaatgtaagtttggaagtactaaaagactattttatacttgttgattaatcggaatgtttgttgtatgccttcattttccatttcacttatatgtgtatgtccatatatgttaattttcattgtagcaaagctaatggaaataaagctaatgctctagttgaaagaaaaggaaaactcctgaaatcctagaatgtcttgttatttttagctgactgtaaaatattatgaacagtctttgtgtattgtgcttaatgcttttgtaagaaacagaatttgaaatatttcatccttgtcatgctcaaaattttgttacatgcttgttattcagagtataataaagttttgtacaggcctga

SEQ ID NO: 436573 - DNA, 397 bp, Homo sapiens
tcatagagataattgaatgctgatatgaaattaactgtttgcagatagatttgaagtggattttgacaagggtgaggttgaagaatagatgatgatattgtttaggctggaatggtttttctttgtaattaatttcagttttattttcagggtgatcgtggacttcctggttttcctgggcttcatggcatgccaggatcaaagggtgaaatgggtgccaaaggagacaaaggatcacctggattttatggcaaaaagggaagtatagatcacacaacaaagtattcatattgaacttttaatgtaatggaaacagaaaactagaattgcagttctaacccagcattagaacagttagctctgttcacccttcttaggggattaattcagaacaatg

SEQ ID NO: 436574 - DNA, 2771 bp, Homo sapiens
  misc_feature (2700)..(2700): n is a, c, g, or t
atgattgcatcagtaagggagttattaagagaaaagattgccattttttatatgaatatttaggttcttgggtatttcaaggctcaggtgggaggcaatcatttaattaaattaatttttaactaaggtggtgacactgagggcttgtggaactgttgcgctaaatcagaacttatatcatttaacagattttcttgcatgattcattagaatacaagaatgtgttcaaatgaaacatcattttaattttatcactcatgtgttggggtgcaagaactgagatgaatttcctcatagtttctttttcaaaaagcctttatttaaagctctaaatatcagtaatattcatataatgctatatctcctaagttgtcttttccatattggattattacaaatagcaatattataatatgtatacatttgaaaatatgttatttaccagttaaaattccaattgtgactgtttcttctttaatgataaagtcttcaattttttataagttaaaaatctattttatttgtttttagggaatcccaggatttcctggaaaccgaggattaatgggccaaaagggagaaattgggcctccaggacagcaaggaaaaaaaggagccccagggatgcctggtttaatgggaagcaatggctcaccaggccagcctggaacaccgggatctaagggaagcaaaggtgaacctggaattcaagggatgcctggggcttcagggctcaagggagaaccaggagcaacgggttccccaggagaaccaggatacatgggtttacccgggattcaaggaaaaaagggggacaaaggaaatcaaggtgaaaaaggtattcagggtcaaaagggagaaaatggaagacagggaattccagggcaacagggaattcaaggccatcatggtgcaaaaggagagagaggtgaaaagggagaacctggtgtccgaggtgccattggatcaaaaggagaatctggggtggatggcttgatggggcccgcaggtcctaaggggcaacctggggatccaggtcctcagggacccccaggtttggatgggaagcccggaagagagttttcagaacaatttattcgacaagtttgcacagatgtaataagagcccagctaccagtcttacttcagagtggaagaattagaaattgtgatcattgcctgtcccaacatggctccccgggtattcctgggccacctggtccgataggcccagagggtcccagaggattacctggtttgccaggaagagatggtgttcctggattagtgggtgtccctggacgtccaggtgtcagaggattaaaaggcctaccaggaagaaatggggaaaaagggagccaagggtttgggtatcctggagaacaaggtcctcctggtcccccaggtccagagggccctcctggaataagcaaagaaggtcctccaggagacccaggtctccctggcaaagatggagaccatggaaaacctggaatccaagggcaaccaggccccccaggcatctgcgacccatcactatgttttagtgtaattgccagaagagatccgttcagaaaaggaccaaactattagtgtctgatgcctcattcagcagcctaggcatggtgctttttctgtggtcttttgcatctcaggaagataaccaacagtaatcccttgaaaagaaacttaagtacctcggtgtttttattttttttttcttatggaaaaaaatataaaagatcacatatactgattttaaaggctcctcagtcatttggagcccttggattagcagcattaattaaatctcaagggtttcttgtaaagtccatttatgttaatcaaagttgaatataaaaatccaccattgcctgttagccagtcagttttagtcactgtgaaatatttcacattcagcctccatgcagtagagatttgagtttaatttcatgtccatgtgactttcatgtttcctatctcatagctcatgctactacataagccaaaacatgtatctcatcattggaagtaagatcagggctgatattcacctgggatagacagtattggtgaactactcatttactacagtgtctcagccttgataaagggcagtggattgcctgttgttcggtgttgtgaatagcacctctgaataagattagagtgtttcttaattcatttcaaactctaaaattagattaatggtggtgctaagaaagagtattaattactttgggaatggtcaaaattaacattaaaaacattttagacaaaaagtttcattgtacattcaaagaaaatgtaagtttggaagtactaaaagactattttatacttgttgattaatcggaatgtttgttgtatgccttcattttccatttcacttatatgtgtatgtccatatatgttaattttcattgtagcaaagctaatggaaataaagctaatgctctagttgaaagaaaaggaaaactcctgaaatcctagaatgtcttgttatttttagctgactgtaaaatattatgaacagtctttgtgtattgtgcttaatgcttttgtaagaaacagaatttgaaatatttcatccttgtcatgctcaaaattttgttacatgcttgttattcagagtataataaagttttgtacaggcctgaaaaaaaaaccgaaacagacgagctacctaagacagctaanagagcacactcgtctatgtagctagtggggattattggtagaggcgaccctaccgagccttgtgatgctgt

SEQ ID NO: 436575 - DNA, 3903 bp, Homo sapiens
  misc_feature (3832)..(3832): n is a, c, g, or t
gggggcccgctgcagggagaacggactccgggcggagggcagccaatccgtttcagcgcaggtcttgctcgggttgggcttgccactgcctggaacatacctgtccccctggcgcaacactcagctggctgcgaccgcaaccccgagcctggacactgcgccaggaatcctaaaaccaaaatattagaacgaaaacagaaacatggctcactatattacatttctctgcatggttttggtgctgcttcttcagaattctgtgttagctgaagatggggaagtaagatcaagttgtcgtactgctccgacagatttagttttcatcttagatggctcttatagtgttggcccagaaaactttgaaatagtgaaaaagtggcttgtcaatatcacaaaaaactttgacatagggccgaagtttattcaagttggagtggttcaatatagtgactaccctgtgctggagattcctctcggaagctatgattcaggagaacatttgacggcagcagtggaatccatactctacttaggaggaaacacaaagacagggaaggccatccagtttgcgctcgattacctttttgccaagtcctcacgatttctgactaagatagcagtggtacttacggatggcaagtcccaagatgacgtcaaggatgcagctcaagcagcaagagatagtaagataacattatttgctattggtgttggttcagaaacagaagatgccgaacttagagctattgccaacaagccttcgtctacttatgtgttttatgtggaagactatattgcaatatccaaaataagggaagtgatgaagcagaaactttgtgaagaatctgtctgtccaacacgaattccagtggcagctcgtgatgaaaggggatttgatattcttttgggtttagatgtaaataaaaaggttaagaaaagaatacagctttcaccaaaaaagataaaaggatatgaagtaacatcaaaagttgatttatcagaactcacaagcaatgttttcccagaaggtcttcctccatcatatgtatttgtgtctactcaaagatttaaagtcaagaaaatttgggatttatggagaatattaactattgatggaaggccacaaatagcagttaccttaaatggtgtggacaaaatcttattatttacaacaaccagcgtaattaatggctcacaagtggttacctttgctaaccctcaagttaagacgttgtttgatgaaggctggcaccaaattcgtctcttagtaacagaacaagatgtgactttgtatattgatgaccaacaaattgaaaacaagcccttacatccagttttagggatcttgatcaatgggcaaacccaaattggaaaatattctggaaaagaagaaactgttcagtttgatgtccaaaagttgcgaatctactgtgacccagaacagaacaaccgggagacagcatgtgagattcctggatttaatggagagtgccttaatggtcccagtgatgtaggttcaactccagctccctgtatttgtcctccgggaaaaccaggacttcaaggccccaaaggtgaccctggactgcctgggaaccctggctaccctggacaacctggtcaagatggtaagcctggatatcagggaattgcagggacaccaggtgttccaggatctccaggaatacaaggagctcgaggactaccaggttacaaaggagaaccagggcgagatggtgacaagggtgatcgtggacttcctggttttcctgggcttcatggcatgccaggatcaaagggtgaaatgggtgccaaaggagacaaaggatcacctggattttatggcaaaaagggtgcaaaaggtgaaaaggggaatgctggcttccctggcctccctggacctgctggagaaccaggaagacatggaaaggatggattaatgggtagtcccggtttcaagggagaagcaggatcccctggtgctccggggcaggatggaacacggggagagcctggaatcccaggatttcctggaaaccgaggattaatgggccaaaagggagaaattgggcctccaggacagcaaggaaaaaaaggagccccagggatgcctggtttaatgggaagcaatggctcaccaggccagcctggaacaccgggatctaagggaagcaaaggtgaacctggaattcaagggatgcctggggcttcagggctcaagggagaaccaggagcaacgggttccccaggagaaccaggatacatgggtttacccgggattcaaggaaaaaagggggacaaaggaaatcaaggtgaaaaaggtattcagggtcaaaagggagaaaatggaagacagggaattccagggcaacagggaattcaaggccatcatggtgcaaaaggagagagaggtgaaaagggagaacctggtgtccgaggtgccattggatcaaaaggagaatctggggtggatggcttgatggggcccgcaggtcctaaggggcaacctggggatccaggtcctcagggacccccaggtttggatgggaagcccggaagagagttttcagaacaatttattcgacaagtttgcacagatgtaataagagaccatggaaaacctggaatccaagggcaaccaggccccccaggcatctgcgacccatcactatgttttagtgtaattgccagaagagatccgttcagaaaaggaccaaactattagtgtctgatgcctcattcagcagcctaggcatggtgctttttctgtggtcttttgcatctcaggaagataaccaacagtaatcccttgaaaagaaacttaagtacctcggtgtttttattttttttttcttatggaaaaaaatataaaagatcacatatactgattttaaaggctcctcagtcatttggagcccttggattagcagcattaattaaatctcaagggtttcttgtaaagtccatttatgttaatcaaagttgaatataaaaatccaccattgcctgttagccagtcagttttagtcactgtgaaatatttcacattcagcctccatgcagtagagatttgagtttaatttcatgtccatgtgactttcatgtttcctatctcatagctcatgctactacataagccaaaacatgtatctcatcattggaagtaagatcagggctgatattcacctgggatagacagtattggtgaactactcatttactacagtgtctcagccttgataaagggcagtggattgcctgttgttcggtgttgtgaatagcacctctgaataagattagagtgtttcttaattcatttcaaactctaaaattagattaatggtggtgctaagaaagagtattaattactttgggaatggtcaaaattaacattaaaaacattttagacaaaaagtttcattgtacattcaaagaaaatgtaagtttggaagtactaaaagactattttatacttgttgattaatcggaatgtttgttgtatgccttcattttccatttcacttatatgtgtatgtccatatatgttaattttcattgtagcaaagctaatggaaataaagctaatgctctagttgaaagaaaaggaaaactcctgaaatcctagaatgtcttgttatttttagctgactgtaaaatattatgaacagtctttgtgtattgtgcttaatgcttttgtaagaaacagaatttgaaatatttcatccttgtcatgctcaaaattttgttacatgcttgttattcagagtataataaagttttgtacaggcctgaaaaaaaaaccgaaacagacgagctacctaagacagctaanagagcacactcgtctatgtagctagtggggattattggtagaggcgaccctaccgagccttgtgatgctgt

SEQ ID NO: 436576 - DNA, 4435 bp, Homo sapiens
gggggcccgctgcagggagaacggactccgggcggagggcagccaatccgtttcagcgcaggtcttgctcgggttgggcttgccactgcctggaacatacctgtccccctggcgcaacactcagctggctgcgaccgcaaccccgagcctggacactgcgccaggaatcctaaaaccaaaatattagaacgaaaacagaaacatggctcactatattacatttctctgcatggttttggtgctgcttcttcagaattctgtgttagctgaagatggggaagtaagatcaagttgtcgtactgctccgacagatttagttttcatcttagatggctcttatagtgttggcccagaaaactttgaaatagtgaaaaagtggcttgtcaatatcacaaaaaactttgacatagggccgaagtttattcaagttggagtggttcaatatagtgactaccctgtgctggagattcctctcggaagctatgattcaggagaacatttgacggcagcagtggaatccatactctacttaggaggaaacacaaagacagggaaggccatccagtttgcgctcgattacctttttgccaagtcctcacgatttctgactaagatagcagtggtacttacggatggcaagtcccaagatgacgtcaaggatgcagctcaagcagcaagagatagtaagataacattatttgctattggtgttggttcagaaacagaagatgccgaacttagagctattgccaacaagccttcgtctacttatgtgttttatgtggaagactatattgcaatatccaaaataagggaagtgatgaagcagaaactttgtgaagaatctgtctgtccaacacgaattccagtggcagctcgtgatgaaaggggatttgatattcttttgggtttagatgtaaataaaaaggttaagaaaagaatacagctttcaccaaaaaagataaaaggatatgaagtaacatcaaaagttgatttatcagaactcacaagcaatgttttcccagaaggtcttcctccatcatatgtatttgtgtctactcaaagatttaaagtcaagaaaatttgggatttatggagaatattaactattgatggaaggccacaaatagcagttaccttaaatggtgtggacaaaatcttattatttacaacaaccagcgtaattaatggctcacaagtggttacctttgctaaccctcaagttaagacgttgtttgatgaaggctggcaccaaattcgtctcttagtaacagaacaagatgtgactttgtatattgatgaccaacaaattgaaaacaagcccttacatccagttttagggatcttgatcaatgggcaaacccaaattggaaaatattctggaaaagaagaaactgttcagtttgatgtccaaaagttgcgaatctactgtgacccagaacagaacaaccgggagacagcatgtgagattcctggatttaatggagagtgccttaatggtcccagtgatgtaggttcaactccagctccctgtatttgtcctccgggaaaaccaggacttcaaggccccaaaggtgaccctggactgcctgggaaccctggctaccctggacaacctggtcaagatggtaagcctggatatcagggaattgcagggacaccaggtgttccaggatctccaggaatacaaggagctcgaggactaccaggttacaaaggagaaccagggcgagatggtgacaagggtgatcgtggacttcctggttttcctgggcttcatggcatgccaggatcaaagggtgaaatgggtgccaaaggagacaaaggatcacctggattttatggcaaaaagggtgcaaaaggtgaaaaggggaatgctggcttccctggcctccctggacctgctggagaaccaggaagacatggaaaggatggattaatgggtagtcccggtttcaagggagaagcaggatcccctggtgctccggggcaggatggaacacggggagagcctggaatcccaggatttcctggaaaccgaggattaatgggccaaaagggagaaattgggcctccaggacagcaaggaaaaaaaggagccccagggatgcctggtttaatgggaagcaatggctcaccaggccagcctggaacaccgggatctaagggaagcaaaggtgaacctggaattcaagggatgcctggggcttcagggctcaagggagaaccaggagcaacgggttccccaggagaaccaggatacatgggtttacccgggattcaaggaaaaaagggggacaaaggaaatcaaggtgaaaaaggtattcagggtcaaaagggagaaaatggaagacagggaattccagggcaacagggaattcaaggccatcatggtgcaaaaggagagagaggtgaaaagggagaacctggtgtccgaggtgccattggatcaaaaggagaatctggggtggatggcttgatggggcccgcaggtcctaaggggcaacctggggatccaggtcctcagggacccccaggtttggatgggaagcccggaagagagttttcagaacaatttattcgacaagtttgcacagatgtaataagagcccagctaccagtcttacttcagagtggaagaattagaaattgtgatcattgcctgtcccaacatggctccccgggtattcctgggccacctggtccgataggcccagagggtcccagaggattacctggtttgccaggaagagatggtgttcctggattagtgggtgtccctggacgtccaggtgtcagaggattaaaaggcctaccaggaagaaatggggaaaaagggagccaagggtttgggtatcctggagaacaaggtcctcctggtcccccaggtccagagggccctcctggaataagcaaagaaggtcctccaggagacccaggtctccctggcaaagatggagaccatggaaaacctggaatccaagggcaaccaggccccccaggcatctgcgacccatcactatgttttagtgtaattgccagaagagatccgttcagaaaaggaccaaactattagtgtctgatgcctcattcagcagcctaggcatggtgctttttctgtggtcttttgcatctcaggaagataaccaacagtaatcccttgaaaagaaacttaagtacctcggtgtttttattttttttttcttatggaaaaaaatataaaagatcacatatactgattttaaaggctcctcagtcatttggagcccttggattagcagcattaattaaatctcaagggtttcttgtaaagtccatttatgttaatcaaagttgaatataaaaatccaccattgcctgttagccagtcagttttagtcactgtgaaatatttcacattcagcctccatgcagtagagatttgagtttaatttcatgtccatgtgactttcatgtttcctatctcatagctcatgctactacataagccaaaacatgtatctcatcattggaagtaagatcagggctgatattcacctgggatagacagtattggtgaactactcatttactacagtgtctcagccttgataaagggcagtggattgcctgttgttcggtgttgtgaatagcacctctgaataagattagagtgtttcttaattcatttcaaactctaaaattagattaatggtggtgctaagaaagagtattaattactttgggaatggtcaaaattaacattaaaaacattttagacaaaaagtttcattgtacattcaaagaaaatgtaagtttggaagtactaaaagactattttatacttgttgattaatcggaatgtttgttgtatgccttcattttccatttcacttatatgtgtatgtccatatatgttaattttcattgtagcaaagctaatggaaataaagctaatgctctagttgaaagaaaaggaaaactcctgaaatcctagaatgtcttgttatttttagctgactgtaaaatattatgaacagtctttgtgtattgtgcttaatgcttttgtaagaaacagaatttgaaatatttcatccttgtcatgctcaaaattttgttacatgcttgttattcagagtataataaagttttgtacaggcctgaaaaaaaaaaaaaaaaaaaaaaaaaaaaaaaaaaaaaaaaaaaaaaaaaaaaaaaaaaacacaacaaaaaaaaaaaaaaaaaaaaaaaaaaagatgtgcgtgcgcgcgcgcgagcgcgcgagcgagaaagagatctcgtacaaacacgtgcggtgggggcgcgcgcggccaaaaggaaagaacgaaaacggagaaaaacaggcgctccaaaaaaaacccggagaaaaaaacgcgggggggctatccccacaaaaaaaaagcgccggcgcgggaaaaagagggtcataaaaaac

SEQ ID NO: 436577 - DNA, 2341 bp, Homo sapiens
gggggcccgctgcagggagaacggactccgggcggagggcagccaatccgtttcagcgcaggtcttgctcgggttgggcttgccactgcctggaacatacctgtccccctggcgcaacactcagctggctgcgaccgcaaccccgagcctggacactgcgccaggaatcctaaaaccaaaatattagaacgaaaacagaaacatggctcactatattacatttctctgcatggttttggtgctgcttcttcagaattctgtgttagctgaagatggggaagtaagatcaagttgtcgtactgctccgacagatttagttttcatcttagatggctcttatagtgttggcccagaaaactttgaaatagtgaaaaagtggcttgtcaatatcacaaaaaactttgacatagggccgaagtttattcaagttggagtggttcaatatagtgactaccctgtgctggagattcctctcggaagctatgattcaggagaacatttgacggcagcagtggaatccatactctacttaggaggaaacacaaagacagggaaggccatccagtttgcgctcgattacctttttgccaagtcctcacgatttctgactaagatagcagtggtacttacggatggcaagtcccaagatgacgtcaaggatgcagctcaagcagcaagagatagtaagataacattatttgctattggtgttggttcagaaacagaagatgccgaacttagagctattgccaacaagccttcgtctacttatgtgttttatgtggaagactatattgcaatatccaaaataagggaagtgatgaagcagaaactttgtgaagaatctgtctgtccaacacgaattccagtggcagctcgtgatgaaaggggatttgatattcttttgggtttagatgtaaataaaaaggttaagaaaagaatacagctttcaccaaaaaagataaaaggatatgaagtaacatcaaaagttgatttatcagaactcacaagcaatgttttcccagaaggtcttcctccatcatatgtatttgtgtctactcaaagatttaaagtcaagaaaatttgggatttatggagaatattaactattgatggaaggccacaaatagcagttaccttaaatggtgtggacaaaatcttattatttacaacaaccagcgtaattaatggctcacaagtggttacctttgctaaccctcaagttaagacgttgtttgatgaaggctggcaccaaattcgtctcttagtaacagaacaagatgtgactttgtatattgatgaccaacaaattgaaaacaagcccttacatccagttttagggatcttgatcaatgggcaaacccaaattggaaaatattctggaaaagaagaaactgttcagtttgatgtccaaaagttgcgaatctactgtgacccagaacagaacaaccgggagacagcatgtgagattcctggatttaatggagagtgccttaatggtcccagtgatgtaggttcaactccagctccctgtatttgtcctccgggaaaaccaggacttcaaggccccaaaggtgaccctggactgcctgggaaccctggctaccctggacaacctggtcaagatggtaagcctggatatcagggaattgcagggacaccaggtgttccaggatctccaggaatacaaggagctcgaggactaccaggttacaaaggagaaccagggcgagatggtgacaagggtgatcgtggacttcctggttttcctgggcttcatggcatgccaggatcaaagggtgaaatgggtgccaaaggagacaaaggatcacctggattttatggcaaaaagggtgcaaaaggtgaaaaggggaatgctggcttccctggcctccctggacctgctggagaaccaggaagacatggaaaggatggattaatgggtagtcccggtttcaagggagaagcaggatcccctggtgctccggggcaggatggaacacggggagagcctggaatcccaggatttcctggaaaccgaggattaatgggccaaaagggagaaattgggcctccaggacagcaaggaaaaaaaggagccccagggatgcctggtttaatgggaagcaatggctcaccaggccagcctggaacaccgggatctaagggaagcaaaggtgaacctggaattcaagggatgcctggggcttcagggctcaagggagaaccaggagcaacgggttccccaggagaaccaggatacatgggtttacccgggattcaaggaaaaaaggtatgcattggttaggagatacagttcgcttttaaccagttacttgca

SEQ ID NO: 436578 - DNA, 487 bp, Homo sapiens
aaaaatataattaacaccaactcaccatttaaacataagggatggggtttctttgtttttgaaagcccagctaccagtcttacttcagagtggaagaattagaaattgtgatcattgcctgtcccaacatggctccccgggtattcctgggccacctggtccgataggcccagagggtcccagaggattacctggtttgccaggaagagatggtgttcctggattagtgggtgtccctggacgtccaggtgtcagaggattaaaaggtatgcagttagtttcaacaagaaaatgaattttaaaaagtctttttttaaaaattcataccctatatccatttaatagtcgagttaacttttttcatgataaaaaaatctgtaaatgctcgtctttaaataatttgccaactgaattaaagagaaattattttcttaatgcaatattctcaaaaagagaagtcaaatttatgaacacataaacttacaaa

SEQ ID NO: 436579 - DNA, 4254 bp, Homo sapiens
  misc_feature (4183)..(4183): n is a, c, g, or t
gggggcccgctgcagggagaacggactccgggcggagggcagccaatccgtttcagcgcaggtcttgctcgggttgggcttgccactgcctggaacatacctgtccccctggcgcaacactcagctggctgcgaccgcaaccccgagcctggacactgcgccaggaatcctaaaaccaaaatattagaacgaaaacagaaacatggctcactatattacatttctctgcatggttttggtgctgcttcttcagaattctgtgttagctgaagatggggaagtaagatcaagttgtcgtactgctccgacagatttagttttcatcttagatggctcttatagtgttggcccagaaaactttgaaatagtgaaaaagtggcttgtcaatatcacaaaaaactttgacatagggccgaagtttattcaagttggagtggttcaatatagtgactaccctgtgctggagattcctctcggaagctatgattcaggagaacatttgacggcagcagtggaatccatactctacttaggaggaaacacaaagacagggaaggccatccagtttgcgctcgattacctttttgccaagtcctcacgatttctgactaagatagcagtggtacttacggatggcaagtcccaagatgacgtcaaggatgcagctcaagcagcaagagatagtaagataacattatttgctattggtgttggttcagaaacagaagatgccgaacttagagctattgccaacaagccttcgtctacttatgtgttttatgtggaagactatattgcaatatccaaaataagggaagtgatgaagcagaaactttgtgaagaatctgtctgtccaacacgaattccagtggcagctcgtgatgaaaggggatttgatattcttttgggtttagatgtaaataaaaaggttaagaaaagaatacagctttcaccaaaaaagataaaaggatatgaagtaacatcaaaagttgatttatcagaactcacaagcaatgttttcccagaaggtcttcctccatcatatgtatttgtgtctactcaaagatttaaagtcaagaaaatttgggatttatggagaatattaactattgatggaaggccacaaatagcagttaccttaaatggtgtggacaaaatcttattatttacaacaaccagcgtaattaatggctcacaagtggttacctttgctaaccctcaagttaagacgttgtttgatgaaggctggcaccaaattcgtctcttagtaacagaacaagatgtgactttgtatattgatgaccaacaaattgaaaacaagcccttacatccagttttagggatcttgatcaatgggcaaacccaaattggaaaatattctggaaaagaagaaactgttcagtttgatgtccaaaagttgcgaatctactgtgacccagaacagaacaaccgggagacagcatgtgagattcctggatttaatggagagtgccttaatggtcccagtgatgtaggttcaactccagctccctgtatttgtcctccgggaaaaccaggacttcaaggccccaaaggtgaccctggactgcctgggaaccctggctaccctggacaacctggtcaagatggtaagcctggatatcagggaattgcagggacaccaggtgttccaggatctccaggaatacaaggagctcgaggactaccaggttacaaaggagaaccagggcgagatggtgacaagggtgatcgtggacttcctggttttcctgggcttcatggcatgccaggatcaaagggtgaaatgggtgccaaaggagacaaaggatcacctggattttatggcaaaaagggtgcaaaaggtgaaaaggggaatgctggcttccctggcctccctggacctgctggagaaccaggaagacatggaaaggatggattaatgggtagtcccggtttcaagggagaagcaggatcccctggtgctccggggcaggatggaacacggggagagcctggaatcccaggatttcctggaaaccgaggattaatgggccaaaagggagaaattgggcctccaggacagcaaggaaaaaaaggagccccagggatgcctggtttaatgggaagcaatggctcaccaggccagcctggaacaccgggatctaagggaagcaaaggtgaacctggaattcaagggatgcctggggcttcagggctcaagggagaaccaggagcaacgggttccccaggagaaccaggatacatgggtttacccgggattcaaggaaaaaagggggacaaaggaaatcaaggtgaaaaaggtattcagggtcaaaagggagaaaatggaagacagggaattccagggcaacagggaattcaaggccatcatggtgcaaaaggagagagaggtgaaaagggagaacctggtgtccgaggtgccattggatcaaaaggagaatctggggtggatggcttgatggggcccgcaggtcctaaggggcaacctggggatccaggtcctcagggacccccaggtttggatgggaagcccggaagagagttttcagaacaatttattcgacaagtttgcacagatgtaataagagcccagctaccagtcttacttcagagtggaagaattagaaattgtgatcattgcctgtcccaacatggctccccgggtattcctgggccacctggtccgataggcccagagggtcccagaggattacctggtttgccaggaagagatggtgttcctggattagtgggtgtccctggacgtccaggtgtcagaggattaaaaggcctaccaggaagaaatggggaaaaagggagccaagggtttgggtatcctggagaacaaggtcctcctggtcccccaggtccagagggccctcctggaataagcaaagaaggtcctccaggagacccaggtctccctggcaaagatggagaccatggaaaacctggaatccaagggcaaccaggccccccaggcatctgcgacccatcactatgttttagtgtaattgccagaagagatccgttcagaaaaggaccaaactattagtgtctgatgcctcattcagcagcctaggcatggtgctttttctgtggtcttttgcatctcaggaagataaccaacagtaatcccttgaaaagaaacttaagtacctcggtgtttttattttttttttcttatggaaaaaaatataaaagatcacatatactgattttaaaggctcctcagtcatttggagcccttggattagcagcattaattaaatctcaagggtttcttgtaaagtccatttatgttaatcaaagttgaatataaaaatccaccattgcctgttagccagtcagttttagtcactgtgaaatatttcacattcagcctccatgcagtagagatttgagtttaatttcatgtccatgtgactttcatgtttcctatctcatagctcatgctactacataagccaaaacatgtatctcatcattggaagtaagatcagggctgatattcacctgggatagacagtattggtgaactactcatttactacagtgtctcagccttgataaagggcagtggattgcctgttgttcggtgttgtgaatagcacctctgaataagattagagtgtttcttaattcatttcaaactctaaaattagattaatggtggtgctaagaaagagtattaattactttgggaatggtcaaaattaacattaaaaacattttagacaaaaagtttcattgtacattcaaagaaaatgtaagtttggaagtactaaaagactattttatacttgttgattaatcggaatgtttgttgtatgccttcattttccatttcacttatatgtgtatgtccatatatgttaattttcattgtagcaaagctaatggaaataaagctaatgctctagttgaaagaaaaggaaaactcctgaaatcctagaatgtcttgttatttttagctgactgtaaaatattatgaacagtctttgtgtattgtgcttaatgcttttgtaagaaacagaatttgaaatatttcatccttgtcatgctcaaaattttgttacatgcttgttattcagagtataataaagttttgtacaggcctgaaaaaaaaaccgaaacagacgagctacctaagacagctaanagagcacactcgtctatgtagctagtggggattattggtagaggcgaccctaccgagccttgtgatgctgt

SEQ ID NO: 436580 - DNA, 2331 bp, Homo sapiens
  misc_feature (2260)..(2260): n is a, c, g, or t
gtaggcagggactgggttctactgtgagctgagatccctggagctccatgaaaaggagaaaaagaatgccgtgtttcctggatctatggagggaatcccaggatttcctggaaaccgaggattaatgggccaaaagggagaaattgggcctccaggacagcaaggaaaaaaaggagccccagggatgcctggtttaatgggaagcaatggctcaccaggccagcctggaacaccgggatctaagggaagcaaaggtgaacctggaattcaagggatgcctggggcttcagggctcaagggagaaccaggagcaacgggttccccaggagaaccaggatacatgggtttacccgggattcaaggaaaaaagggggacaaaggaaatcaaggtgaaaaaggtattcagggtcaaaagggagaaaatggaagacagggaattccagggcaacagggaattcaaggccatcatggtgcaaaaggagagagaggtgaaaagggagaacctggtgtccgaggtgccattggatcaaaaggagaatctggggtggatggcttgatggggcccgcaggtcctaaggggcaacctggggatccaggtcctcagggacccccaggtttggatgggaagcccggaagagagttttcagaacaatttattcgacaagtttgcacagatgtaataagagcccagctaccagtcttacttcagagtggaagaattagaaattgtgatcattgcctgtcccaacatggctccccgggtattcctgggccacctggtccgataggcccagagggtcccagaggattacctggtttgccaggaagagatggtgttcctggattagtgggtgtccctggacgtccaggtgtcagaggattaaaaggcctaccaggaagaaatggggaaaaagggagccaagggtttgggtatcctggagaacaaggtcctcctggtcccccaggtccagagggccctcctggaataagcaaagaaggtcctccaggagacccaggtctccctggcaaagatggagaccatggaaaacctggaatccaagggcaaccaggccccccaggcatctgcgacccatcactatgttttagtgtaattgccagaagagatccgttcagaaaaggaccaaactattagtgtctgatgcctcattcagcagcctaggcatggtgctttttctgtggtcttttgcatctcaggaagataaccaacagtaatcccttgaaaagaaacttaagtacctcggtgtttttattttttttttcttatggaaaaaaatataaaagatcacatatactgattttaaaggctcctcagtcatttggagcccttggattagcagcattaattaaatctcaagggtttcttgtaaagtccatttatgttaatcaaagttgaatataaaaatccaccattgcctgttagccagtcagttttagtcactgtgaaatatttcacattcagcctccatgcagtagagatttgagtttaatttcatgtccatgtgactttcatgtttcctatctcatagctcatgctactacataagccaaaacatgtatctcatcattggaagtaagatcagggctgatattcacctgggatagacagtattggtgaactactcatttactacagtgtctcagccttgataaagggcagtggattgcctgttgttcggtgttgtgaatagcacctctgaataagattagagtgtttcttaattcatttcaaactctaaaattagattaatggtggtgctaagaaagagtattaattactttgggaatggtcaaaattaacattaaaaacattttagacaaaaagtttcattgtacattcaaagaaaatgtaagtttggaagtactaaaagactattttatacttgttgattaatcggaatgtttgttgtatgccttcattttccatttcacttatatgtgtatgtccatatatgttaattttcattgtagcaaagctaatggaaataaagctaatgctctagttgaaagaaaaggaaaactcctgaaatcctagaatgtcttgttatttttagctgactgtaaaatattatgaacagtctttgtgtattgtgcttaatgcttttgtaagaaacagaatttgaaatatttcatccttgtcatgctcaaaattttgttacatgcttgttattcagagtataataaagttttgtacaggcctgaaaaaaaaaccgaaacagacgagctacctaagacagctaanagagcacactcgtctatgtagctagtggggattattggtagaggcgaccctaccgagccttgtgatgctgt

SEQ ID NO: 436581 - DNA, 1928 bp, Homo sapiens
gggggcccgctgcagggagaacggactccgggcggagggcagccaatccgtttcagcgcaggtcttgctcgggttgggcttgccactgcctggaacatacctgtccccctggcgcaacactcagctggctgcgaccgcaaccccgagcctggacactgcgccaggaatcctaaaaccaaaatattagaacgaaaacagaaacatggctcactatattacatttctctgcatggttttggtgctgcttcttcagaattctgtgttagctgaagatggggaagtaagatcaagttgtcgtactgctccgacagatttagttttcatcttagatggctcttatagtgttggcccagaaaactttgaaatagtgaaaaagtggcttgtcaatatcacaaaaaactttgacatagggccgaagtttattcaagttggagtggttcaatatagtgactaccctgtgctggagattcctctcggaagctatgattcaggagaacatttgacggcagcagtggaatccatactctacttaggaggaaacacaaagacagggaaggccatccagtttgcgctcgattacctttttgccaagtcctcacgatttctgactaagatagcagtggtacttacggatggcaagtcccaagatgacgtcaaggatgcagctcaagcagcaagagatagtaagataacattatttgctattggtgttggttcagaaacagaagatgccgaacttagagctattgccaacaagccttcgtctacttatgtgttttatgtggaagactatattgcaatatccaaaataagggaagtgatgaagcagaaactttgtgaagaatctgtctgtccaacacgaattccagtggcagctcgtgatgaaaggggatttgatattcttttgggtttagatgtaaataaaaaggttaagaaaagaatacagctttcaccaaaaaagataaaaggatatgaagtaacatcaaaagttgatttatcagaactcacaagcaatgttttcccagaaggtcttcctccatcatatgtatttgtgtctactcaaagatttaaagtcaagaaaatttgggatttatggagaatattaactattgatggaaggccacaaatagcagttaccttaaatggtgtggacaaaatcttattatttacaacaaccagcgtaattaatggctcacaagtggttacctttgctaaccctcaagttaagacgttgtttgatgaaggctggcaccaaattcgtctcttagtaacagaacaagatgtgactttgtatattgatgaccaacaaattgaaaacaagcccttacatccagttttagggatcttgatcaatgggcaaacccaaattggaaaatattctggaaaagaagaaactgttcagtttgatgtccaaaagttgcgaatctactgtgacccagaacagaacaaccgggagacagcatgtgagattcctggatttaatggagagtgccttaatggtcccagtgatgtaggttcaactccagctccctgtatttgtcctccgggaaaaccaggacttcaaggccccaaaggatatcagggaattgcagggacaccaggtgttccaggatctccaggaatacaaggagctcgaggactaccaggttacaaaggagaaccagggcgagatggtgacaagggtgatcgtggacttcctggttttcctgggcttcatggcatgccaggatcaaagggtgaaatgggtgccaaaggagacaaaggatcacctggattttatggcaaaaagggaagtatagatcacacaacaaagtattcatattgaacttttaatgtaatggaaacagaaaactagaattgcagttctaacccagcattagaacagttagctctgttcacccttcttaggggattaattcagaacaatg

SEQ ID NO: 436582 - DNA, 2311 bp, Homo sapiens
atacgactacacctgctccggagcccgcggcggtacctgcagcggaggagctctgtcttccccttcatctcacgcgagcccggcgtcccgccgcgtgcgccccggcgcagcccgccagtccgcccggagcccgcccagtcgccgcgctgcacgcccggggtgaaccctctgccctcgctgggacagagggccccgcagccgtcatgctttccgccatctacacagtcctggcgggactgctgttcctgccgctcctggtgaacctctgctgcccatacttcttccaggacataggctacttcttgaaggtggccgccgtgggccggagggtgcgcagctacgggcagcggcggccggcgcgcaccatcctgcgggcgttcctggagaaagcgcgccagacgccacacaagccttttctgctcttccgcgacgagactctcacctacgcgcaggtggaccggcgcagcaatcaagtggcccgggcgctgcacgaccacctcggcctgcgccagggagactgcgtggcgctccttatgggtaacgagccggcctacgtgtggctgtggctggggctggtgaagctgggctgtgccatggcgtgcctcaattacaacatccgcgcgaagtccctgctgcactgcttccagtgctgcggggcgaaggtgctgctggtgtcgccagaactacaagcagctgtcgaagagatactgccaagccttaaaaaagatgatgtgtccatctattatgtgagcagaacttctaacacagatgggattgactctttcctggacaaagtggatgaagtatcaactgaacctatcccagagtcatggaggtctgaagtcactttttccactcctgccttatacatttatacttctggaaccacaggtcttccaaaagcagccatgatcactcatcagcgcatatggtatggaactggcctcacttttgtaagcggattgaaggcagatgatgtcatctatatcactctgcccttttaccacagtgctgcactactgattggcattcacggatgtattgtggctggtgctactcttgccttgcggactaaattttcagccagccagttttgggatgactgcagaaaatacaacgtcactgtcattcagtatatcggtgaactgcttcggtatttatgcaactcaccacagaaaccaaatgaccgtgatcataaagtgagactggcactgggaaatggcttacgaggagatgtgtggagacaatttgtcaagagatttggggacatatgcatctatgagttctatgctgccactgaaggcaatattggatttatgaattatgcgagaaaagttggtgctgttggaagagtaaactacctacagaaaaaaatcataacttatgacctgattaaatatgatgtggagaaagatgaacctgtccgtgatgaaaatggatattgcgtcagagttcccaaaggtgaagttggacttctggtttgcaaaatcacacaacttacaccatttaatggctatgctggagcaaaggctcagacagagaagaaaaaactgagagatgtctttaagaaaggagacctctatttcaacagtggagatctcttaatggttgaccatgaaaatttcatctatttccacgacagagttggagatacattccggtggaaaggggaaaatgtggccaccactgaagttgctgatacagttggactggttgattttgtccaagaagtaaatgtttatggagtgcatgtgccagatcatgagggtcgcattggcatggcctccatcaaaatgaaagctagttatgcaaggccccggtttctaagaatacaggacaccattgagatcactggaacttttaaacaccgcaaaatgaccctggtggaggagggctttaaccctgctgtcatcaaagatgccttgtatttcttggatgacacagcaaaaatgtatgtgcctatgactgaggacatctataatgccataagtgctaaaaccctgaaactctgaatattcccaggaggataactcaacatttccagaaagaaactgaatggacagccacttgatataatccaactttaatttgattgaagattgtgaggaaattttgtaggaaatttgcatacccgtaaagggagacttttttaaataacagttgagtctttgcaagtaaaaagatttagagattattatttttcagtgtgcacctactgtttgtatttgcaaactgagcttgttggagggaaggcattattttttaaaatacttagtaaattaaatgaacaccaacatgtgaaaaaaaaatg

SEQ ID NO: 436583 - DNA, 476 bp, Homo sapiens
gagactggcactgggaaatggcttacgaggagatgtgtggagacaatttgtcaagagatttggggacatatgcatctatgagttctatgctgccactgaaggcaatattggatttatgaattatgcgagaaaagttggtgctgttggaagagtaaactacctacagaaagtaagtacattgaaaaatgagagcatacgtagccagttttcagaatacagagacttcttaaaagccaagtcatgatgatgttatcagaagtcaggcagcatcagagccatggcccattcctatcaccaagagaagttttgctcattctctgtgatgatgacttcaaaaaatcagatcctccaattaaaagcatctcaacttctattaagaacaatccattgtgcccttgccatctgcaacttaggtgaagtcttcctgatgccatttatacttgcatgtgataaaacacctgaaggttacaagttcc

SEQ ID NO: 436584 - DNA, 2365 bp, Homo sapiens
atacgactacacctgctccggagcccgcggcggtacctgcagcggaggagctctgtcttccccttcatctcacgcgagcccggcgtcccgccgcgtgcgccccggcgcagcccgccagtccgcccggagcccgcccagtcgccgcgctgcacgcccggggtgaaccctctgccctcgctgggacagagggccccgcagccgtcatgctttccgccatctacacagtcctggcgggactgctgttcctgccgctcctggtgaacctctgctgcccatacttcttccaggacataggctacttcttgaaggtggccgccgtgggccggagggtgcgcagctacgggcagcggcggccggcgcgcaccatcctgcgggcgttcctggagaaagcgcgccagacgccacacaagccttttctgctcttccgcgacgagactctcacctacgcgcaggtggaccggcgcagcaatcaagtggcccgggcgctgcacgaccacctcggcctgcgccagggagactgcgtggcgctccttatgggtaacgagccggcctacgtgtggctgtggctggggctggtgaagctgggctgtgccatggcgtgcctcaattacaacatccgcgcgaagtccctgctgcactgcttccagtgctgcggggcgaaggtgctgctggtgtcgccagaactacaagcagctgtcgaagagatactgccaagccttaaaaaagatgatgtgtccatctattatgtgagcagaacttctaacacagatgggattgactctttcctggacaaagtggatgaagtatcaactgaacctatcccagagtcatggaggtctgaagtcactttttccactcctgccttatacatttatacttctggaaccacaggtcttccaaaagcagccatgatcactcatcagcgcatatggtatggaactggcctcacttttgtaagcggattgaaggcagatgatgtcatctatatcactctgcccttttaccacagtgctgcactactgattggcattcacggatgtattgtggctggtgctactcttgccttgcggactaaattttcagccagccagttttgggatgactgcagaaaatacaacgtcactgtcattcagtatatcggtgaactgcttcggtatttatgcaactcaccacagaaaccaaatgaccgtgatcataaagtgagactggcactgggaaatggcttacgaggagatgtgtggagacaatttgtcaagagatttggggacatatgcatctatgagttctatgctgccactgaaggcaatattggatttatgaattatgcgagaaaagttggtgctgttggaagagtaaactacctacagaaaaaaatcataacttatgacctgattaaatatgatgtggagaaagatgaacctgtccgtgatgaaaatggatattgcgtcagagttcccaaaggtgaagttggacttctggtttgcaaaatcacacaacttacaccatttaatggctatgctggagcaaaggctcagacagagaagaaaaaactgagagatgtctttaagaaaggagacctctatttcaacagtggagatctcttaatggttgaccatgaaaatttcatctatttccacgacagagttggagatacattccggtggaaaggggaaaatgtggccaccactgaagttgctgatacagttggactggttgattttgtccaagaagtaaatgtttatggagtgcatgtgccagatcatgagggtcgcattggcatggcctccatcaaaatgaaagaaaaccatgaatttgatggaaagaaactctttcagcacattgctgattacctacctagttatgcaaggccccggtttctaagaatacaggacaccattgagatcactggaacttttaaacaccgcaaaatgaccctggtggaggagggctttaaccctgctgtcatcaaagatgccttgtatttcttggatgacacagcaaaaatgtatgtgcctatgactgaggacatctataatgccataagtgctaaaaccctgaaactctgaatattcccaggaggataactcaacatttccagaaagaaactgaatggacagccacttgatataatccaactttaatttgattgaagattgtgaggaaattttgtaggaaatttgcatacccgtaaagggagacttttttaaataacagttgagtctttgcaagtaaaaagatttagagattattatttttcagtgtgcacctactgtttgtatttgcaaactgagcttgttggagggaaggcattattttttaaaatacttagtaaattaaatgaacaccaacatgtgaaaaaaaaatg

SEQ ID NO: 436585 - DNA, 1185 bp, Homo sapiens
gtgaaccgaagtccttatattcccgggcttctttctcctctgggtaccagctccttactgccctgcagacaagcgtgccgtgcgtgcttgtggccaagggaaggaagagctggttgatccacagatagctccttcctccccgccccttcctttttgtttggaggtcccaggatctgtgttcacagacatctgggggaagaaaaggagcaggaaactaccccgcacagagttaagcaggaaacaacaacaacatcatgcaaaaaccctgcaaagaaaacgaaggaaagccaaagtgcagcgtgccaaagagggaggaaaaacgcccgtatggagaatttgaacgccagcaaacagaagggaattttagacagaggctgcttcagtctctcgaagaatttaaagaggacatagactataggcattttaaagatgaagaaatgacaagggagggagatgagatggaaaggtgtttggaagagataaggggtctgagaaagaaatttagggctctgcattctaaccataggcattctcgggaccgtccttatcccatttaattaatttctctgacaattcaattattttctgttattaatgttgccactgctttctgtttgtctgcactttcttgataaatatttgctatcgttttactccagtcattcgatgttgctgagatttacatatgactcttgtcaacatctcatcttttgacccaatcttattcatttaataagaggtctcattcatttgcatggaaaaatgctcattgtatattgcaaagtgaaaataacgagttgcaaaacagtgtatacatatatgtgtgtatatatgtacactttatttgtacatttctatgtgacataatgcaaaggaaagtgtctgattttattatacaccaaaggttaacagtgaatctctgtgtgatctctttttttttctttttgcctatctgcatcttctcacttgccaaaaaatgaatatatgtttatgtgtgtatattacttgtgtcacaaaaaaccctaaagtagacagtaaaagaacttgtcaatcgcctttggaaggcaatgaaacacttaataaactctcaataacagaagcgtaaaaatgaaatgtaaacctccaattacctctggatctcttagccagagtaataaactggtaattattacagataaaaaaaaa

SEQ ID NO: 436586 - DNA, 1131 bp, Homo sapiens
gtgaaccgaagtccttatattcccgggcttctttctcctctgggtaccagctccttactgccctgcagacaagcgtgccgtgcgtgcttgtggccaagggaaggaagaggtcccaggatctgtgttcacagacatctgggggaagaaaaggagcaggaaactaccccgcacagagttaagcaggaaacaacaacaacatcatgcaaaaaccctgcaaagaaaacgaaggaaagccaaagtgcagcgtgccaaagagggaggaaaaacgcccgtatggagaatttgaacgccagcaaacagaagggaattttagacagaggctgcttcagtctctcgaagaatttaaagaggacatagactataggcattttaaagatgaagaaatgacaagggagggagatgagatggaaaggtgtttggaagagataaggggtctgagaaagaaatttagggctctgcattctaaccataggcattctcgggaccgtccttatcccatttaattaatttctctgacaattcaattattttctgttattaatgttgccactgctttctgtttgtctgcactttcttgataaatatttgctatcgttttactccagtcattcgatgttgctgagatttacatatgactcttgtcaacatctcatcttttgacccaatcttattcatttaataagaggtctcattcatttgcatggaaaaatgctcattgtatattgcaaagtgaaaataacgagttgcaaaacagtgtatacatatatgtgtgtatatatgtacactttatttgtacatttctatgtgacataatgcaaaggaaagtgtctgattttattatacaccaaaggttaacagtgaatctctgtgtgatctctttttttttctttttgcctatctgcatcttctcacttgccaaaaaatgaatatatgtttatgtgtgtatattacttgtgtcacaaaaaaccctaaagtagacagtaaaagaacttgtcaatcgcctttggaaggcaatgaaacacttaataaactctcaataacagaagcgtaaaaatgaaatgtaaacctccaattacctctggatctcttagccagagtaataaactggtaattattacagataaaaaaaaa

SEQ ID NO: 436587 - DNA, 1803 bp, Homo sapiens
gtgaaccgaagtccttatattcccgggcttctttctcctctgggtaccagctccttactgccctgcagacaagcgtgccgtgcgtgcttgtggccaagggaaggaagaggtaaattccttaaatcccagcaggttggagtgaaggaaccactggacccccggggtcagtagtgggtgaatctaatgactggaataggtccagacttgctttcccaaaaccgctgcaaaatcgtcggagataattgtatcttttgcagggggaagcaagggggtaggtcgaaatcttttgagagacacctagagatttagtgacagctttgaaataatcggcttctctcaccctggcatgctttctttttatccttctcctcatctttctccaattttgttaagagaaaattttaggcctggggtatgtgttggtgtgtggagaaaggctgaaatcccgggatggagacaacagaaatttagagatcatttgaaaatagttcacctcactcaatgccggcctgtggtggtggggtggggcgcgggacggggcgaaggagggagacgcgggccttgcaaggcccaggcctgagggtgaggagtggggagtggaaacggaaatcctgaaggaaaggatacagacaggaaggaggggccaggaggtagaaatccggggggcgatgacggtgatgatgagaatcccaggttcaaaataataacgtctgtcttgtctctggagctggttgatccacagatagctccttcctccccgccccttcctttttgtttggaggtcccaggatctgtgttcacagacatctgggggaagaaaaggagcaggaaactaccccgcacagagttaagcaggaaacaacaacaacatcatgcaaaaaccctgcaaagaaaacgaaggaaagccaaagtgcagcgtgccaaagagggaggaaaaacgcccgtatggagaatttgaacgccagcaaacagaagggaattttagacagaggctgcttcagtctctcgaagaatttaaagaggacatagactataggcattttaaagatgaagaaatgacaagggagggagatgagatggaaaggtgtttggaagagataaggggtctgagaaagaaatttagggctctgcattctaaccataggcattctcgggaccgtccttatcccatttaattaatttctctgacaattcaattattttctgttattaatgttgccactgctttctgtttgtctgcactttcttgataaatatttgctatcgttttactccagtcattcgatgttgctgagatttacatatgactcttgtcaacatctcatcttttgacccaatcttattcatttaataagaggtctcattcatttgcatggaaaaatgctcattgtatattgcaaagtgaaaataacgagttgcaaaacagtgtatacatatatgtgtgtatatatgtacactttatttgtacatttctatgtgacataatgcaaaggaaagtgtctgattttattatacaccaaaggttaacagtgaatctctgtgtgatctctttttttttctttttgcctatctgcatcttctcacttgccaaaaaatgaatatatgtttatgtgtgtatattacttgtgtcacaaaaaaccctaaagtagacagtaaaagaacttgtcaatcgcctttggaaggcaatgaaacacttaataaactctcaataacagaagcgtaaaaatgaaatgtaaacctccaattacctctggatctcttagccagagtaataaactggtaattattacagataaaaaaaaa

SEQ ID NO: 436588 - DNA, 1169 bp, Homo sapiens
gcttcggtgcagagctggagagccgcggctgggaccggagtggggagcgcggcgtggaggtgccacccggcgcgggtggcggagagatcagaagcctcttccccaagccgagccaacctcagcggggacccgggctcagggacgcggcggcggcggcggcgactgcagtggctggacgatggcagcgtccgccggagccggggcggtgattgcagccccagacagccggcgctggctgtggtcggtgctggcggcggcgcttgggctcttgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgtttttccactactcccaagggcaagtgtaccttgggaattatccaccatttaaagacagaatcagctgggctggagaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaagagaatttgcctgtgtttccagtttgggtagtggtgggcatagttactgctgtggtcctaggtctcactctgctcatcagcatgattctggctgtcctctatagaaggaaaaactctaaacgggattacactggctgcagtacatcagagagtttgtcaccagttaagcaggctcctcggaagtccccctccgacactgagggtcttgtaaagagtctgccttctggatctcaccagggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcct

SEQ ID NO: 436589 - DNA, 1319 bp, Homo sapiens
gcttcggtgcagagctggagagccgcggctgggaccggagtggggagcgcggcgtggaggtgccacccggcgcgggtggcggagagatcagaagcctcttccccaagccgagccaacctcagcggggacccgggctcagggacgcggcggcggcggcggcgactgcagtggctggacgatggcagcgtccgccggagccggggcggtgattgcagccccagacagccggcgctggctgtggtcggtgctggcggcggcgcttgggctcttgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgtttttccactactcccaagggcaagtgtaccttgggaattatccaccatttaaagacagaatcagctgggctggagaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaagagaatttgcctgtgtttccagtttgggtagtggtgggcatagttactgctgtggtcctaggtctcactctgctcatcagcatgattctggctgtcctctatagaaggaaaaactctaaacgggattacactgggtaagaaacactgtttttttagggcaggggtggagggagggaatcagggtttatagaaacttctgtatttaatgaaaaaaggattttaaagaattaactactattttctttcatgtcagaatcaggcagtctccttaggaggtgttctaacatgggcaagtggaaatcagtgggcctgctattaaatgtggaatatgattctaatctctgttccagtttccttcttaggtttggtgagatgagctgctcagcagtctgtgctctgtgtttcaataccatccactatgcaattagtattcttaagacatcacttacccaatttaagagtttaatttcaatttcttgctaataaactcacaaggtggttctttccagttaggaaatataaaaccctaattaagaagttgtgagctggaattagtggcatgtgcctgtaagtcccagctacttaggctgtggcaggaggattgcttgagccgaggcgtttgaatctagcctaggcaacatagcaagatcctgtctctttaaaaaaaaaa

SEQ ID NO: 436590 - DNA, 423 bp, Homo sapiens
  misc_feature (57)..(57): n is a, c, g, or t
agggggggggcaaggggggaaacccccttctcttctttctcccaaaaaggggccccncttgggcaaacaaacccacaaccccactagcaaagaccccttatgtgtgcgttcacgcactcttattgttaacccaccacctttgggcactcctttcctggttgcagataacgaactaaggttgcctaaagggcagatctgccctctccatgtcttcgtcctggcaaacagggtcgtcttaaaattatgcgctaattctgtatgggagcactcaaaaggcattacttagagattgaaatttcaaactatctctagtttttcaatggaaatatatcagctagggaaaaaccatcaagctcattattattttttgatcttcagttgtatttttgtgaatattttaatacatctttttcaatttctgaa

SEQ ID NO: 436591 - DNA, 3787 bp, Homo sapiens
gcttcggtgcagagctggagagccgcggctgggaccggagtggggagcgcggcgtggaggtgccacccggcgcgggtggcggagagatcagaagcctcttccccaagccgagccaacctcagcggggacccgggctcagggacgcggcggcggcggcggcgactgcagtggctggacgatggcagcgtccgccggagccggggcggtgattgcagccccagacagccggcgctggctgtggtcggtgctggcggcggcgcttgggctcttgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgtttttccactactcccaagggcaagtgtaccttgggaattatccaccatttaaagacagaatcagctgggctggagaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaagagaatttgcctgtgtttccagtttgggtagtggtgggcatagttactgctgtggtcctaggtctcactctgctcatcagcatgattctggctgtcctctatagaaggaaaaactctaaacgggattacactggggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatggtttgccttaatggagacaatagcagatcctgtagtatttccagtagacatggccttttaatctaagggcttaagactgattagtcttagcatttactgtagttggaggatggagatgctatgatggaagcatacccagggtggcctttagcacagtatcagtaccatttatttgtctgccgcttttaaaaaatacccattggctatgccacttgaaaacaatttgagaagtttttttgaagtttttctcactaaaatatggggcaattgttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggttttattctttgctgatgtcctttctgcttgaaataacagtcaccatacagctaaaggagaggagtttctttccttctaagtaggcagaaatggtatcattatgttgccgctctccaatctcccagagctcgctctctagagaatcaccttctttcgcttttttttttttttttgaggtagagtctcactatgttgcccagactagccttgaactcttgggctcaagtgattctccctcctcagcctcccgagtagctggaacgaactatagttgcaccactgcagctggcaagaatcaccttctttataaagcgtcagtcatgcttccagcaagaggcagcatcagtcatggctttataacagcttcatggtgcctcaaagactgttgaggttaatgagagcctagattagacagtttggctgtccttccctaaaacttgttttctcctattcactactccccaccgcacttaaaatctatgagtttttactttttactgggaatggaaagtgtggtgaagatcattcaacacttatgttgtcatttctcccattttctgaatttttttttaaatttccccccttttaaaattgttcgaaagcccacagttatggaaagaattactgtctagatggtctgcagaacgtgtttggggtgagtgggagtgaggggcaatgttactttttctccctgtagtttggagtccattatgagctgctgctttttcttctcatcttgtcatcttctggggatgtttgaaggctgagttccaacagaattcacaaagggaataaaacaggattgagattttgaggtgtgcacaaggtggtaagataaagggcatatgagcttcaaaactaatgctgttgcatacatgaagccttttgttttttgaggagctatttttgttattcttgtaacgctccaccttacatgccacgtctgtgtgagtcaacagggatcaggtttggtcaccacacatgtctgaagctgggcagcgtctgctctgtgttctgtgtggaatggagaaaaaaacgcctgccctgctgccttccatgttcataggcccagcccaagagagtgacacacagtgctggccctgagacatttccacaaagtggtcaactctgccttgcatcctaaaactttttgggcatctattttgaaaactataggagcctttggaaggcctcttatgtttggaggggaagggtgttgagattgtcaccatccttcaagctgagactcctggtgagcctttgccaccatgaaaaccacatagctgaccagggctgtgcttgaggtacagaggacacacatcgtagacaggcctgtgtcatgtttccttacagtcgttttttacagagaaaaggggcattgttttttcactgctttctcaacagttcctgtgaataaatgaaacatttcggagctccctgagagcaagagccttcacttcttcttgcggtgccgggaccatgtgttggtgaagctggtgctgtgggggccactcactcgaatgacacctggaggcctgttcctcccttaccactcccttccccagcccgacttcttggcctcctgcccaaccagacacctcaaactctgtcagtgccctggcattctggcagagaatcctcaccagttctcaccaaccttccccccaggcaagggcagctgccagcatggtgctctgccaggacaggtttccctgaaggaagctgctcacactgagatgagcctctcagggcaggacctcttcccaagccctgcacacccacccctgcagcccttttggctccccttttccctgtgcctcagcactcctttcctggttgcagataacgaactaaggttgcctaaagggcagatctgccctctccatgtcttcgtcctggcaaacagggtcgtcttaaaattatgcgctaattctgtatgggagcactcaaaaggcattacttagagattgaaatttcaaactatctctagtttttcaatggaaatatatcagctagggaaaaaccatcaagctcattattattttttgatcttcagttgtatttttgtgaatattttaatacatctttttcaatttctgaa

SEQ ID NO: 436592 - DNA, 3717 bp, Homo sapiens
gcttcggtgcagagctggagagccgcggctgggaccggagtggggagcgcggcgtggaggtgccacccggcgcgggtggcggagagatcagaagcctcttccccaagccgagccaacctcagcggggacccgggctcagggacgcggcggcggcggcggcgactgcagtggctggacgatggcagcgtccgccggagccggggcggtgattgcagccccagacagccggcgctggctgtggtcggtgctggcggcggcgcttgggctcttgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgtttttccactactcccaagggcaagtgtaccttgggaattatccaccatttaaagacagaatcagctgggctggagaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaagagaatttgcctgtgtttccagtttgggtagtggtgggcatagttactgctgtggtcctaggtctcactctgctcatcagcatgattctggctgtcctctatagaaggaaaaactctaaacgggattacactggctgcagtacatcagagagtttgtcaccagttaagcaggctcctcggaagtccccctccgacactgagggtcttgtaaagagtctgccttctggatctcaccagggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatggtttgccttaatggagacaatagcagatcctgtagtatttccagtagacatggccttttaatctaagggcttaagactgattagtcttagcatttactgtagttggaggatggagatgctatgatggaagcatacccagggtggcctttagcacagtatcagtaccatttatttgtctgccgcttttaaaaaatacccattggctatgccacttgaaaacaatttgagaagtttttttgaagtttttctcactaaaatatggggcaattgttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggttttattctttgctgatgtcctttctgcttgaaataacagtcaccatacagctaaaggagaggagtttctttccttctaagtaggcagaaatggtatcattatgttgccgctctccaatctcccagagctcgctctctagagaatcaccttctttcgcttttttttttttttttgaggtagagtctcactatgttgcccagactagccttgaactcttgggctcaagtgattctccctcctcagcctcccgagtagctggaacgaactatagttgcaccactgcagctggcaagaatcaccttctttataaagcgtcagtcatgcttccagcaagaggcagcatcagtcatggctttataacagcttcatggtgcctcaaagactgttgaggttaatgagagcctagattagacagtttggctgtccttccctaaaacttgttttctcctattcactactccccaccgcacttaaaatctatgagtttttactttttactgggaatggaaagtgtggtgaagatcattcaacacttatgttgtcatttctcccattttctgaatttttttttaaatttccccccttttaaaattgttcgaaagcccacagttatggaaagaattactgtctagatggtctgcagaacgtgtttggggtgagtgggagtgaggggcaatgttactttttctccctgtagtttggagtccattatgagctgctgctttttcttctcatcttgtcatcttctggggatgtttgaaggctgagttccaacagaattcacaaagggaataaaacaggattgagattttgaggtgtgcacaaggtggtaagataaagggcatatgagcttcaaaactaatgctgttgcatacatgaagccttttgttttttgaggagctatttttgttattcttgtaacgctccaccttacatttccacaaagtggtcaactctgccttgcatcctaaaactttttgggcatctattttgaaaactataggagcctttggaaggcctcttatgtttggaggggaagggtgttgagattgtcaccatccttcaagctgagactcctggtgagcctttgccaccatgaaaaccacatagctgaccagggctgtgcttgaggtacagaggacacacatcgtagacaggcctgtgtcatgtttccttacagtcgttttttacagagaaaaggggcattgttttttcactgctttctcaacagttcctgtgaataaatgaaacatttcggagctccctgagagcaagagccttcacttcttcttgcggtgccgggaccatgtgttggtgaagctggtgctgtgggggccactcactcgaatgacacctggaggcctgttcctcccttaccactcccttccccagcccgacttcttggcctcctgcccaaccagacacctcaaactctgtcagtgccctggcattctggcagagaatcctcaccagttctcaccaaccttccccccaggcaagggcagctgccagcatggtgctctgccaggacaggtttccctgaaggaagctgctcacactgagatgagcctctcagggcaggacctcttcccaagccctgcacacccacccctgcagcccttttggctccccttttccctgtgcctcagcactcctttcctggttgcagataacgaactaaggttgcctaaagggcagatctgccctctccatgtcttcgtcctggcaaacagggtcgtcttaaaattatgcgctaattctgtatgggagcactcaaaaggcattacttagagattgaaatttcaaactatctctagtttttcaatggaaatatatcagctagggaaaaaccatcaagctcattattattttttgatcttcagttgtatttttgtgaatattttaatacatctttttcaatttctgaa

SEQ ID NO: 436593 - DNA, 3126 bp, Homo sapiens
tcgctaggtggcctaggtattctcttaattctttcggatatccgcatacaccacaggctcctcggaagtccccctccgacactgagggtcttgtaaagagtctgccttctggatctcaccagggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatggtttgccttaatggagacaatagcagatcctgtagtatttccagtagacatggccttttaatctaagggcttaagactgattagtcttagcatttactgtagttggaggatggagatgctatgatggaagcatacccagggtggcctttagcacagtatcagtaccatttatttgtctgccgcttttaaaaaatacccattggctatgccacttgaaaacaatttgagaagtttttttgaagtttttctcactaaaatatggggcaattgttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggttttattctttgctgatgtcctttctgcttgaaataacagtcaccatacagctaaaggagaggagtttctttccttctaagtaggcagaaatggtatcattatgttgccgctctccaatctcccagagctcgctctctagagaatcaccttctttcgcttttttttttttttttgaggtagagtctcactatgttgcccagactagccttgaactcttgggctcaagtgattctccctcctcagcctcccgagtagctggaacgaactatagttgcaccactgcagctggcaagaatcaccttctttataaagcgtcagtcatgcttccagcaagaggcagcatcagtcatggctttataacagcttcatggtgcctcaaagactgttgaggttaatgagagcctagattagacagtttggctgtccttccctaaaacttgttttctcctattcactactccccaccgcacttaaaatctatgagtttttactttttactgggaatggaaagtgtggtgaagatcattcaacacttatgttgtcatttctcccattttctgaatttttttttaaatttccccccttttaaaattgttcgaaagcccacagttatggaaagaattactgtctagatggtctgcagaacgtgtttggggtgagtgggagtgaggggcaatgttactttttctccctgtagtttggagtccattatgagctgctgctttttcttctcatcttgtcatcttctggggatgtttgaaggctgagttccaacagaattcacaaagggaataaaacaggattgagattttgaggtgtgcacaaggtggtaagataaagggcatatgagcttcaaaactaatgctgttgcatacatgaagccttttgttttttgaggagctatttttgttattcttgtaacgctccaccttacatgccacgtctgtgtgagtcaacagggatcaggtttggtcaccacacatgtctgaagctgggcagcgtctgctctgtgttctgtgtggaatggagaaaaaaacgcctgccctgctgccttccatgttcataggcccagcccaagagagtgacacacagtgctggccctgagacatttccacaaagtggtcaactctgccttgcatcctaaaactttttgggcatctattttgaaaactataggagcctttggaaggcctcttatgtttggaggggaagggtgttgagattgtcaccatccttcaagctgagactcctggtgagcctttgccaccatgaaaaccacatagctgaccagggctgtgcttgaggtacagaggacacacatcgtagacaggcctgtgtcatgtttccttacagtcgttttttacagagaaaaggggcattgttttttcactgctttctcaacagttcctgtgaataaatgaaacatttcggagctccctgagagcaagagccttcacttcttcttgcggtgccgggaccatgtgttggtgaagctggtgctgtgggggccactcactcgaatgacacctggaggcctgttcctcccttaccactcccttccccagcccgacttcttggcctcctgcccaaccagacacctcaaactctgtcagtgccctggcattctggcagagaatcctcaccagttctcaccaaccttccccccaggcaagggcagctgccagcatggtgctctgccaggacaggtttccctgaaggaagctgctcacactgagatgagcctctcagggcaggacctcttcccaagccctgcacacccacccctgcagcccttttggctccccttttccctgtgcctcagcactcctttcctggttgcagataacgaactaaggttgcctaaagggcagatctgccctctccatgtcttcgtcctggcaaacagggtcgtcttaaaattatgcgctaattctgtatgggagcactcaaaaggcattacttagagattgaaatttcaaactatctctagtttttcaatggaaatatatcagctagggaaaaaccatcaagctcattattattttttgatcttcagttgtatttttgtgaatattttaatacatctttttcaatttctgaa

SEQ ID NO: 436594 - DNA, 3440 bp, Homo sapiens
gcttcggtgcagagctggagagccgcggctgggaccggagtggggagcgcggcgtggaggtgccacccggcgcgggtggcggagagatcagaagcctcttccccaagccgagccaacctcagcggggacccgggctcagggacgcggcggcggcggcggcgactgcagtggctggacgatggcagcgtccgccggagccggggcggtgattgcagccccagacagccggcgctggctgtggtcggtgctggcggcggcgcttgggctcttgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatggtttgccttaatggagacaatagcagatcctgtagtatttccagtagacatggccttttaatctaagggcttaagactgattagtcttagcatttactgtagttggaggatggagatgctatgatggaagcatacccagggtggcctttagcacagtatcagtaccatttatttgtctgccgcttttaaaaaatacccattggctatgccacttgaaaacaatttgagaagtttttttgaagtttttctcactaaaatatggggcaattgttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggttttattctttgctgatgtcctttctgcttgaaataacagtcaccatacagctaaaggagaggagtttctttccttctaagtaggcagaaatggtatcattatgttgccgctctccaatctcccagagctcgctctctagagaatcaccttctttcgcttttttttttttttttgaggtagagtctcactatgttgcccagactagccttgaactcttgggctcaagtgattctccctcctcagcctcccgagtagctggaacgaactatagttgcaccactgcagctggcaagaatcaccttctttataaagcgtcagtcatgcttccagcaagaggcagcatcagtcatggctttataacagcttcatggtgcctcaaagactgttgaggttaatgagagcctagattagacagtttggctgtccttccctaaaacttgttttctcctattcactactccccaccgcacttaaaatctatgagtttttactttttactgggaatggaaagtgtggtgaagatcattcaacacttatgttgtcatttctcccattttctgaatttttttttaaatttccccccttttaaaattgttcgaaagcccacagttatggaaagaattactgtctagatggtctgcagaacgtgtttggggtgagtgggagtgaggggcaatgttactttttctccctgtagtttggagtccattatgagctgctgctttttcttctcatcttgtcatcttctggggatgtttgaaggctgagttccaacagaattcacaaagggaataaaacaggattgagattttgaggtgtgcacaaggtggtaagataaagggcatatgagcttcaaaactaatgctgttgcatacatgaagccttttgttttttgaggagctatttttgttattcttgtaacgctccaccttacatgccacgtctgtgtgagtcaacagggatcaggtttggtcaccacacatgtctgaagctgggcagcgtctgctctgtgttctgtgtggaatggagaaaaaaacgcctgccctgctgccttccatgttcataggcccagcccaagagagtgacacacagtgctggccctgagacatttccacaaagtggtcaactctgccttgcatcctaaaactttttgggcatctattttgaaaactataggagcctttggaaggcctcttatgtttggaggggaagggtgttgagattgtcaccatccttcaagctgagactcctggtgagcctttgccaccatgaaaaccacatagctgaccagggctgtgcttgaggtacagaggacacacatcgtagacaggcctgtgtcatgtttccttacagtcgttttttacagagaaaaggggcattgttttttcactgctttctcaacagttcctgtgaataaatgaaacatttcggagctccctgagagcaagagccttcacttcttcttgcggtgccgggaccatgtgttggtgaagctggtgctgtgggggccactcactcgaatgacacctggaggcctgttcctcccttaccactcccttccccagcccgacttcttggcctcctgcccaaccagacacctcaaactctgtcagtgccctggcattctggcagagaatcctcaccagttctcaccaaccttccccccaggcaagggcagctgccagcatggtgctctgccaggacaggtttccctgaaggaagctgctcacactgagatgagcctctcagggcaggacctcttcccaagccctgcacacccacccctgcagcccttttggctccccttttccctgtgcctcagcactcctttcctggttgcagataacgaactaaggttgcctaaagggcagatctgccctctccatgtcttcgtcctggcaaacagggtcgtcttaaaattatgcgctaattctgtatgggagcactcaaaaggcattacttagagattgaaatttcaaactatctctagtttttcaatggaaatatatcagctagggaaaaaccatcaagctcattattattttttgatcttcagttgtatttttgtgaatattttaatacatctttttcaatttctgaa

SEQ ID NO: 436595 - DNA, 3075 bp, Homo sapiens
gggccctggtgagatccagaaggcagactctttacaagaccctcagtgtcggagggggacttccgaggagcctgcttaactggtgacaaactctctgatgtactgcagccagtgtaatcccgtttagagtttttccttctatagaggacagccagaatcatgctgatgagcagagtgagacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatggtttgccttaatggagacaatagcagatcctgtagtatttccagtagacatggccttttaatctaagggcttaagactgattagtcttagcatttactgtagttggaggatggagatgctatgatggaagcatacccagggtggcctttagcacagtatcagtaccatttatttgtctgccgcttttaaaaaatacccattggctatgccacttgaaaacaatttgagaagtttttttgaagtttttctcactaaaatatggggcaattgttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggttttattctttgctgatgtcctttctgcttgaaataacagtcaccatacagctaaaggagaggagtttctttccttctaagtaggcagaaatggtatcattatgttgccgctctccaatctcccagagctcgctctctagagaatcaccttctttcgcttttttttttttttttgaggtagagtctcactatgttgcccagactagccttgaactcttgggctcaagtgattctccctcctcagcctcccgagtagctggaacgaactatagttgcaccactgcagctggcaagaatcaccttctttataaagcgtcagtcatgcttccagcaagaggcagcatcagtcatggctttataacagcttcatggtgcctcaaagactgttgaggttaatgagagcctagattagacagtttggctgtccttccctaaaacttgttttctcctattcactactccccaccgcacttaaaatctatgagtttttactttttactgggaatggaaagtgtggtgaagatcattcaacacttatgttgtcatttctcccattttctgaatttttttttaaatttccccccttttaaaattgttcgaaagcccacagttatggaaagaattactgtctagatggtctgcagaacgtgtttggggtgagtgggagtgaggggcaatgttactttttctccctgtagtttggagtccattatgagctgctgctttttcttctcatcttgtcatcttctggggatgtttgaaggctgagttccaacagaattcacaaagggaataaaacaggattgagattttgaggtgtgcacaaggtggtaagataaagggcatatgagcttcaaaactaatgctgttgcatacatgaagccttttgttttttgaggagctatttttgttattcttgtaacgctccaccttacatgccacgtctgtgtgagtcaacagggatcaggtttggtcaccacacatgtctgaagctgggcagcgtctgctctgtgttctgtgtggaatggagaaaaaaacgcctgccctgctgccttccatgttcataggcccagcccaagagagtgacacacagtgctggccctgagacatttccacaaagtggtcaactctgccttgcatcctaaaactttttgggcatctattttgaaaactataggagcctttggaaggcctcttatgtttggaggggaagggtgttgagattgtcaccatccttcaagctgagactcctggtgagcctttgccaccatgaaaaccacatagctgaccagggctgtgcttgaggtacagaggacacacatcgtagacaggcctgtgtcatgtttccttacagtcgttttttacagagaaaaggggcattgttttttcactgctttctcaacagttcctgtgaataaatgaaacatttcggagctccctgagagcaagagccttcacttcttcttgcggtgccgggaccatgtgttggtgaagctggtgctgtgggggccactcactcgaatgacacctggaggcctgttcctcccttaccactcccttccccagcccgacttcttggcctcctgcccaaccagacacctcaaactctgtcagtgccctggcattctggcagagaatcctcaccagttctcaccaaccttccccccaggcaagggcagctgccagcatggtgctctgccaggacaggtttccctgaaggaagctgctcacactgagatgagcctctcagggcaggacctcttcccaagccctgcacacccacccctgcagcccttttggctccccttttccctgtgcctcagcactcctttcctggttgcagataacgaactaaggttgcctaaagggcagatctgccctctccatgtcttcgtcctggcaaacagggtcgtcttaaaattatgcgctaattctgtatgggagcactcaaaaggcattacttagagattgaaatttcaaactatctctagtttttcaatggaaatatatcagctagggaaaaaccatcaagctcattattattttttgatcttcagttgtatttttgtgaatattttaatacatctttttcaatttctgaa

SEQ ID NO: 436596 - DNA, 3587 bp, Homo sapiens
gcttcggtgcagagctggagagccgcggctgggaccggagtggggagcgcggcgtggaggtgccacccggcgcgggtggcggagagatcagaagcctcttccccaagccgagccaacctcagcggggacccgggctcagggacgcggcggcggcggcggcgactgcagtggctggacgatggcagcgtccgccggagccggggcggtgattgcagccccagacagccggcgctggctgtggtcggtgctggcggcggcgcttgggctcttgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgtttttccactactcccaagggcaagtgtaccttgggaattatccaccatttaaagacagaatcagctgggctggagaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaagagaatttgcctgtgtttccagtttgggtagtggtgggcatagttactgctgtggtcctaggtctcactctgctcatcagcatgattctggctgtcctctatagaaggaaaaactctaaacgggattacactggctgcagtacatcagagagtttgtcaccagttaagcaggctcctcggaagtccccctccgacactgagggtcttgtaaagagtctgccttctggatctcaccagggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatggtttgccttaatggagacaatagcagatcctgtagtatttccagtagacatggccttttaatctaagggcttaagactgattagtcttagcatttactgtagttggaggatggagatgctatgatggaagcatacccagggtggcctttagcacagtatcagtaccatttatttgtctgccgcttttaaaaaatacccattggctatgccacttgaaaacaatttgagaagtttttttgaagtttttctcactaaaatatggggcaattgttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggttttattctttgctgatgtcctttctgcttgaaataacagtcaccatacagctaaaggagaggagtttctttccttctaagtaggcagaaatggtatcattatgttgccgctctccaatctcccagagctcgctctctagagaatcaccttctttcgcttttttttttttttttgaggtagagtctcactatgttgcccagactagccttgaactcttgggctcaagtgattctccctcctcagcctcccgagtagctggaacgaactatagttgcaccactgcagctggcaagaatcaccttctttataaagcgtcagtcatgcttccagcaagaggcagcatcagtcatggctttataacagcttcatggtgcctcaaagactgttgaggttaatgagagcctagattagacagtttggctgtccttccctaaaacttgttttctcctattcactactccccaccgcacttaaaatctatgagtttttactttttactgggaatggaaagtgtggtgaagatcattcaacacttatgttgtcatttctcccattttctgaatttttttttaaatttccccccttttaaaattgttcgaaagcccacagttatggaaagaattactgtctagatggtctgcagaacgtgtttggggtgagtgggagtgaggggcaatgttactttttctccctgtagtttggagtccattatgagctgctgctttttcttctcatcttgtcatcttctggggatgtttgaaggctgagttccaacagaattcacaaagggaataaaacaggattgagattttgaggtgtgcacaaggtggtaagataaagggcatatgagcttcaaaactaatgctgttgcatacatgaagccttttgttttttgaggagctatttttgttattcttgtaacgctccaccttacatgccacgtctgtgtgagtcaacagggatcaggtttggtcaccacacatgtctgaagctgggcagcgtctgctctgtgttctgtgtggaatggagaaaaaaacgcctgccctgctgccttccatgttcataggcccagcccaagagagtgacacacagtgctggccctgagacatttccacaaagtggtcaactctgccttgcatcctaaaactttttgggcatctattttgaaaactataggagcctttggaaggcctcttatgtttggaggggaagggtgttgagattgtcaccatccttcaagctgagactcctggtgagcctttgccaccatgaaaaccacatagctgaccagggctgtgcttgaggtacagaggacacacatcgtagacaggcctgtgtcatgtttccttacagtcgttttttacagagaaaaggggcattgttttttcactgctttctcaacagttcctgtgaataaatgaaacatttcggagctccctgagagcaagagccttcacttcttcttgcggtgccgggaccatgtgttggtgaagctggtgctgtgggggccactcactcgaatgacacctggaggcctgttcctcccttaccactcccttccccagcccgacttcttggcctcctgcccaaccagacacctcaaactctgtcagtgccctggcattctggcagagaatcctcaccagttctcaccaaccgcaagggtctttccaggccagaaccgtgtaggtcgccagtgcttttcccagcagtacatagctatgactaagataacgaagatcgagcctcgatacgcctcgatcctgacgagctccgacgcacacacataaattccctg

SEQ ID NO: 436597 - DNA, 3619 bp, Homo sapiens
gcttcggtgcagagctggagagccgcggctgggaccggagtggggagcgcggcgtggaggtgccacccggcgcgggtggcggagagatcagaagcctcttccccaagccgagccaacctcagcggggacccgggctcagggacgcggcggcggcggcggcgactgcagtggctggacgatggcagcgtccgccggagccggggcggtgattgcagccccagacagccggcgctggctgtggtcggtgctggcggcggcgcttgggctcttgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgtttttccactactcccaagggcaagtgtaccttgggaattatccaccatttaaagacagaatcagctgggctggagaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaagagaatttgcctgtgtttccagtttgggtagtggtgggcatagttactgctgtggtcctaggtctcactctgctcatcagcatgattctggctgtcctctatagaaggaaaaactctaaacgggattacactggctgcagtacatcagagagtttgtcaccagttaagcaggctcctcggaagtccccctccgacactgagggtcttgtaaagagtctgccttctggatctcaccagggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatggtttgccttaatggagacaatagcagatcctgtagtatttccagtagacatggccttttaatctaagggcttaagactgattagtcttagcatttactgtagttggaggatggagatgctatgatggaagcatacccagggtggcctttagcacagtatcagtaccatttatttgtctgccgcttttaaaaaatacccattggctatgccacttgaaaacaatttgagaagtttttttgaagtttttctcactaaaatatggggcaattgttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggttttattctttgctgatgtcctttctgcttgaaataacagtcaccatacagctaaaggagaggagtttctttccttctaagtaggcagaaatggtatcattatgttgccgctctccaatctcccagagctcgctctctagagaatcaccttctttcgcttttttttttttttttgaggtagagtctcactatgttgcccagactagccttgaactcttgggctcaagtgattctccctcctcagcctcccgagtagctggaacgaactatagttgcaccactgcagctggcaagaatcaccttctttataaagcgtcagtcatgcttccagcaagaggcagcatcagtcatggctttataacagcttcatggtgcctcaaagactgttgaggttaatgagagcctagattagacagtttggctgtccttccctaaaacttgttttctcctattcactactccccaccgcacttaaaatctatgagtttttactttttactgggaatggaaagtgtggtgaagatcattcaacacttatgttgtcatttctcccattttctgaatttttttttaaatttccccccttttaaaattgttcgaaagcccacagttatggaaagaattactgtctagatggtctgcagaacgtgtttggggtgagtgggagtgaggggcaatgttactttttctccctgtagtttggagtccattatgagctgctgctttttcttctcatcttgtcatcttctggggatgtttgaaggctgagttccaacagaattcacaaagggaataaaacaggattgagattttgaggtgtgcacaaggtggtaagataaagggcatatgagcttcaaaactaatgctgttgcatacatgaagccttttgttttttgaggagctatttttgttattcttgtaacgctccaccttacatgccacgtctgtgtgagtcaacagggatcaggtttggtcaccacacatgtctgaagctgggcagcgtctgctctgtgttctgtgtggaatggagaaaaaaacgcctgccctgctgccttccatgttcataggcccagcccaagagagtgacacacagtgctggccctgagacatttccacaaagtggtcaactctgccttgcatcctaaaactttttgggcatctattttgaaaactataggagcctttggaaggcctcttatgtttggaggggaagggtgttgagattgtcaccatccttcaagctgagactcctggtgagcctttgccaccatgaaaaccacatagctgaccagggctgtgcttgaggtacagaggacacacatcgtagacaggcctgtgtcatgtttccttacagtcgttttttacagagaaaaggggcattgttttttcactgctttctcaacagttcctgtgaataaatgaaacatttcggagctccctgagagcaagagccttcacttcttcttgcggtgccgggaccatgtgttggtgaagctggtgctgtgggggccactcactcgaatgacacctggaggcctgttcctcccttacgcactcctttcctggttgcagataacgaactaaggttgcctaaagggcagatctgccctctccatgtcttcgtcctggcaaacagggtcgtcttaaaattatgcgctaattctgtatgggagcactcaaaaggcattacttagagattgaaatttcaaactatctctagtttttcaatggaaatatatcagctagggaaaaaccatcaagctcattattattttttgatcttcagttgtatttttgtgaatattttaatacatctttttcaatttctgaa

SEQ ID NO: 436598 - DNA, 1368 bp, Homo sapiens
gcttcggtgcagagctggagagccgcggctgggaccggagtggggagcgcggcgtggaggtgccacccggcgcgggtggcggagagatcagaagcctcttccccaagccgagccaacctcagcggggacccgggctcagggacgcggcggcggcggcggcgactgcagtggctggacgatggcagcgtccgccggagccggggcggtgattgcagccccagacagccggcgctggctgtggtcggtgctggcggcggcgcttgggctcttgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgtttttccactactcccaagggcaagtgtaccttgggaattatccaccatttaaagacagaatcagctgggctggagaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaagagaatttgcctgtgtttccagtttgggtagtggtgggcatagttactgctgtggtcctaggtctcactctgctcatcagcatgattctggctgtcctctatagaaggaaaaactctaaacgggattacactggctgcagtacatcagagagtttgtcaccagttaagcaggctcctcggaagtccccctccgacactgagggtcttgtaaagagtctgccttctggatctcaccagggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatgtcgccaatccgtcttgaaatgtcgccaatccgggatcctctagaacaccgcgcat

SEQ ID NO: 436599 - DNA, 637 bp, Homo sapiens
gcttcggtgcagagctggagagccgcggctgggaccggagtggggagcgcggcgtggaggtgccacccggcgcgggtggcggagagatcagaagcctcttccccaagccgagccaacctcagcggggacccgggctcagggacgcggcggcggcggcggcgactgcagtggctggacgatggcagcgtccgccggagccggggcggtgattgcagccccagacagccggcgctggctgtggtcggtgctggcggcggcgcttgggctcttgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgtttttccactactcccaagggcaagtgtaccttgggaattatccaccatttaaagacagaatcagctgggctggagaccttgacaagaaagatgcatcaatcaacactggctcctcatatcaggatgactaaatagaatatttatacatatcctttgtacacatctttctctccctctgtgagtacacgtgtacttgtctc

SEQ ID NO: 436600 - DNA, 1792 bp, Homo sapiens
gcttcggtgcagagctggagagccgcggctgggaccggagtggggagcgcggcgtggaggtgccacccggcgcgggtggcggagagatcagaagcctcttccccaagccgagccaacctcagcggggacccgggctcagggacgcggcggcggcggcggcgactgcagtggctggacgatggcagcgtccgccggagccggggcggtgattgcagccccagacagccggcgctggctgtggtcggtgctggcggcggcgcttgggctcttgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgtttttccactactcccaagggcaagtgtaccttgggaattatccaccatttaaagacagaatcagctgggctggagaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaagagaatttgcctgtgtttccagtttgggtagtggtgggcatagttactgctgtggtcctaggtctcactctgctcatcagcatgattctggctgtcctctatagaaggaaaaactctaaacgggattacactggctgcagtacatcagagagtttgtcaccagttaagcaggctcctcggaagtccccctccgacactgagggtcttgtaaagagtctgccttctggatctcaccagggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatggtttgccttaatggagacaatagcagatcctgtagtatttccagtagacatggccttttaatctaagggcttaagactgattagtcttagcatttactgtagttggaggatggagatgctatgatggaagcatacccagggtggcctttagcacagtatcagtaccatttatttgtctgccgcttttaaaaaatacccattggctatgccacttgaaaacaatttgagaagtttttttgaagtttttctcactaaaatatggggcaattgttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggtttt

SEQ ID NO: 436601 - DNA, 3890 bp, Homo sapiens
gcttcggtgcagagctggagagccgcggctgggaccggagtggggagcgcggcgtggaggtgccacccggcgcgggtggcggagagatcagaagcctcttccccaagccgagccaacctcagcggggacccgggctcagggacgcggcggcggcggcggcgactgcagtggctggacgatggcagcgtccgccggagccggggcggtgattgcagccccagacagccggcgctggctgtggtcggtgctggcggcggcgcttgggctcttgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgtttttccactactcccaagggcaagtgtaccttgggaattatccaccatttaaagacagaatcagctgggctggagaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaagagaatttgcctgtgtttccagtttgggtagtggtgggcatagttactgctgtggtcctaggtctcactctgctcatcagcatgattctggctgtcctctatagaaggaaaaactctaaacgggattacactggctgcagtacatcagagagtttgtcaccagttaagcaggctcctcggaagtccccctccgacactgagggtcttgtaaagagtctgccttctggatctcaccagggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatggtttgccttaatggagacaatagcagatcctgtagtatttccagtagacatggccttttaatctaagggcttaagactgattagtcttagcatttactgtagttggaggatggagatgctatgatggaagcatacccagggtggcctttagcacagtatcagtaccatttatttgtctgccgcttttaaaaaatacccattggctatgccacttgaaaacaatttgagaagtttttttgaagtttttctcactaaaatatggggcaattgttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggttttattctttgctgatgtcctttctgcttgaaataacagtcaccatacagctaaaggagaggagtttctttccttctaagtaggcagaaatggtatcattatgttgccgctctccaatctcccagagctcgctctctagagaatcaccttctttcgcttttttttttttttttgaggtagagtctcactatgttgcccagactagccttgaactcttgggctcaagtgattctccctcctcagcctcccgagtagctggaacgaactatagttgcaccactgcagctggcaagaatcaccttctttataaagcgtcagtcatgcttccagcaagaggcagcatcagtcatggctttataacagcttcatggtgcctcaaagactgttgaggttaatgagagcctagattagacagtttggctgtccttccctaaaacttgttttctcctattcactactccccaccgcacttaaaatctatgagtttttactttttactgggaatggaaagtgtggtgaagatcattcaacacttatgttgtcatttctcccattttctgaatttttttttaaatttccccccttttaaaattgttcgaaagcccacagttatggaaagaattactgtctagatggtctgcagaacgtgtttggggtgagtgggagtgaggggcaatgttactttttctccctgtagtttggagtccattatgagctgctgctttttcttctcatcttgtcatcttctggggatgtttgaaggctgagttccaacagaattcacaaagggaataaaacaggattgagattttgaggtgtgcacaaggtggtaagataaagggcatatgagcttcaaaactaatgctgttgcatacatgaagccttttgttttttgaggagctatttttgttattcttgtaacgctccaccttacatgccacgtctgtgtgagtcaacagggatcaggtttggtcaccacacatgtctgaagctgggcagcgtctgctctgtgttctgtgtggaatggagaaaaaaacgcctgccctgctgccttccatgttcataggcccagcccaagagagtgacacacagtgctggccctgagacatttccacaaagtggtcaactctgccttgcatcctaaaactttttgggcatctattttgaaaactataggagcctttggaaggcctcttatgtttggaggggaagggtgttgagattgtcaccatccttcaagctgagactcctggtgagcctttgccaccatgaaaaccacatagctgaccagggctgtgcttgaggtacagaggacacacatcgtagacaggcctgtgtcatgtttccttacagtcgttttttacagagaaaaggggcattgttttttcactgctttctcaacagttcctgtgaataaatgaaacatttcggagctccctgagagcaagagccttcacttcttcttgcggtgccgggaccatgtgttggtgaagctggtgctgtgggggccactcactcgaatgacacctggaggcctgttcctcccttaccactcccttccccagcccgacttcttggcctcctgcccaaccagacacctcaaactctgtcagtgccctggcattctggcagagaatcctcaccagttctcaccaaccttccccccaggcaagggcagctgccagcatggtgctctgccaggacaggtttccctgaaggaagctgctcacactgagatgagcctctcagggcaggacctcttcccaagccctgcacacccacccctgcagcccttttggctccccttttccctgtgcctcagcactcctttcctggttgcagataacgaactaaggttgcctaaagggcagatctgccctctccatgtcttcgtcctggcaaacagggtcgtcttaaaattatgcgctaattctgtatgggagcactcaaaaggcattacttagagattgaaatttcaaactatctctagtttttcaatggaaatatatcagctagggaaaaaccatcaagctcattattattttttgatcttcagttgtatttttgtgaatattttaatacatctttttcaatttctgaa

SEQ ID NO: 436602 - DNA, 3835 bp, Homo sapiens
gcttcggtgcagagctggagagccgcggctgggaccggagtggggagcgcggcgtggaggtgccacccggcgcgggtggcggagagatcagaagcctcttccccaagccgagccaacctcagcggggacccgggctcagggacgcggcggcggcggcggcgactgcagtggctggacgatggcagcgtccgccggagccggggcggtgattgcagccccagacagccggcgctggctgtggtcggtgctggcggcggcgcttgggctcttgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgtttttccactactcccaagggcaagtgtaccttgggaattatccaccatttaaagacagaatcagctgggctggagaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaagagaatttgcctgtgtttccagtttgggtagtggtgggcatagttactgctgtggtcctaggtctcactctgctcatcagcatgattctggctgtcctctatagaaggaaaaactctaaacgggattacactggctgcagtacatcagagagtttgtcaccagttaagcaggctcctcggaagtccccctccgacactgagggtcttgtaaagagtctgccttctggatctcaccagggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatggtttgccttaatggagacaatagcagatcctgtagtatttccagtagacatggccttttaatctaagggcttaagactgattagtcttagcatttactgtagttggaggatggagatgctatgatggaagcatacccagggtggcctttagcacagtatcagtaccatttatttgtctgccgcttttaaaaaatacccattggctatgccacttgaaaacaatttgagaagtttttttgaagtttttctcactaaaatatggggcaattgttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggttttattctttgctgatgtcctttctgcttgaaataacagtcaccatacagctaaaggagaggagtttctttccttctaagtaggcagaaatggtatcattatgttgccgctctccaatctcccagagctcgctctctagagaatcaccttctttcgcttttttttttttttttgaggtagagtctcactatgttgcccagactagccttgaactcttgggctcaagtgattctccctcctcagcctcccgagtagctggaacgaactatagttgcaccactgcagctggcaagaatcaccttctttataaagcgtcagtcatgcttccagcaagaggcagcatcagtcatggctttataacagcttcatggtgcctcaaagactgttgaggttaatgagagcctagattagacagtttggctgtccttccctaaaacttgttttctcctattcactactccccaccgcacttaaaatctatgagtttttactttttactgggaatggaaagtgtggtgaagatcattcaacacttatgttgtcatttctcccattttctgaatttttttttaaatttccccccttttaaaattgttcgaaagcccacagttatggaaagaattactgtctagatggtctgcagaacgtgtttggggtgagtgggagtgaggggcaatgttactttttctccctgtagtttggagtccattatgagctgctgctttttcttctcatcttgtcatcttctggggatgtttgaaggctgagttccaacagaattcacaaagggaataaaacaggattgagattttgaggtgtgcacaaggtggtaagataaagggcatatgagcttcaaaactaatgctgttgcatacatgaagccttttgttttttgaggagctatttttgttattcttgtaacgctccaccttacatgccacgtctgtgtgagtcaacagggatcaggtttggtcaccacacatgtctgaagctgggcagcgtctgctctgtgttctgtgtggaatggagaaaaaaacgcctgccctgctgccttccatgttcataggcccagcccaagagagtgacacacagtgctggccctgagacatttccacaaagtggtcaactctgccttgcatcctaaaactttttgggcatctattttgaaaactataggagcctttggaaggcctcttatgtttggaggggaagggtgttgagattgtcaccatccttcaagctgagactcctggtgagcctttgccaccatgaaaaccacatagctgaccagggctgtgcttgaggtacagaggacacacatcgtagacaggcctgtgtcatgtttccttacagtcgttttttacagagaaattcggagctccctgagagcaagagccttcacttcttcttgcggtgccgggaccatgtgttggtgaagctggtgctgtgggggccactcactcgaatgacacctggaggcctgttcctcccttaccactcccttccccagcccgacttcttggcctcctgcccaaccagacacctcaaactctgtcagtgccctggcattctggcagagaatcctcaccagttctcaccaaccttccccccaggcaagggcagctgccagcatggtgctctgccaggacaggtttccctgaaggaagctgctcacactgagatgagcctctcagggcaggacctcttcccaagccctgcacacccacccctgcagcccttttggctccccttttccctgtgcctcagcactcctttcctggttgcagataacgaactaaggttgcctaaagggcagatctgccctctccatgtcttcgtcctggcaaacagggtcgtcttaaaattatgcgctaattctgtatgggagcactcaaaaggcattacttagagattgaaatttcaaactatctctagtttttcaatggaaatatatcagctagggaaaaaccatcaagctcattattattttttgatcttcagttgtatttttgtgaatattttaatacatctttttcaatttctgaa

SEQ ID NO: 436603 - DNA, 3841 bp, Homo sapiens
gcttcggtgcagagctggagagccgcggctgggaccggagtggggagcgcggcgtggaggtgccacccggcgcgggtggcggagagatcagaagcctcttccccaagccgagccaacctcagcggggacccgggctcagggacgcggcggcggcggcggcgactgcagtggctggacgatggcagcgtccgccggagccggggcggtgattgcagccccagacagccggcgctggctgtggtcggtgctggcggcggcgcttgggctcttgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgtttttccactactcccaagggcaagtgtaccttgggaattatccaccatttaaagacagaatcagctgggctggagaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaagagaatttgcctgtgtttccagtttgggtagtggtgggcatagttactgctgtggtcctaggtctcactctgctcatcagcatgattctggctgtcctctatagaaggaaaaactctaaacgggattacactggctgcagtacatcagagagtttgtcaccagttaagcaggctcctcggaagtccccctccgacactgagggtcttgtaaagagtctgccttctggatctcaccagggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatggtttgccttaatggagacaatagcagatcctgtagtatttccagtagacatggccttttaatctaagggcttaagactgattagtcttagcatttactgtagttggaggatggagatgctatgatggaagcatacccagggtggcctttagcacagtatcagtaccatttatttgtctgccgcttttaaaaaatacccattggctatgccacttgaaaacaatttgagaagtttttttgaagtttttctcactaaaatatggggcaattgttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggttttattctttgctgatgtcctttctgcttgaaataacagtcaccatacagctaaaggagaggagtttctttccttctaagtaggcagaaatggtatcattatgttgccgctctccaatctcccagagctcgctctctagagaatcaccttctttcgcttttttttttttttttgaggtagagtctcactatgttgcccagactagccttgaactcttgggctcaagtgattctccctcctcagcctcccgagtagctggaacgaactatagttgcaccactgcagctggcaagaatcaccttctttataaagcgtcagtcatgcttccagcaagaggcagcatcagtcatggctttataacagcttcatggtgcctcaaagactgttgaggttaatgagagcctagattagacagtttggctgtccttccctaaaacttgttttctcctattcactactccccaccgcacttaaaatctatgagtttttactttttactgggaatggaaagtgtggtgaagatcattcaacacttatgttgtcatttctcccattttctgaatttttttttaaatttccccccttttaaaattgttcgaaagcccacagttatggaaagaattactgtctagatggtctgcagaacgtgtttggggtgagtgggagtgaggggcaatgttactttttctccctgtagtttggagtccattatgagctgctgctttttcttctcatcttgtcatcttctggggatgtttgaaggctgagttccaacagaattcacaaagggaataaaacaggattgagattttgaggtgtgcacaaggtggtaagataaagggcatatgagcttcaaaactaatgctgttgcatacatgaagccttttgttttttgaggagctatttttgttattcttgtaacgctccaccttacatgccacgtctgtgtgagtcaacagggatcaggtttggtcaccacacatgtctgaagctgggcagcgtctgctctgtgttctgtgtggaatggagaaaaaaacgcctgccctgctgccttccatgttcataggcccagcccaagagagtgacacacagtgctggccctgagacatttccacaaagtggtcaactctgccttgcatcctaaaactttttgggcatctattttgaaaactataggagcctttggaaggcctcttatgtttggaggggaagggtgttgagattgtcaccatccttcaagctgagactcctggtgagcctttgccaccatgaaaaccacatagctgaccagggctgtgcttgaggtacagaggacacacatcgtagacaggcctgtgtcatgtttccttacagtcgttttttacagagaaaaggggcattgttttttcactgctttctcaacagttcctgtgaataaatgaaacatttcggagctccctgagagcaagagccttcacttcttcttgcggtgccgggaccatgtgttggtgaagctggtgctgtgggggccactcactcgaatgacacctggaggcctgttcctcccttaccactcccttccccagcccgacttcttggcctcctgcccaaccagacacctcaaactctgtcagtgccctggcattctggcagagaatcctcaccagttctcaccaaccttccccccaggcaagggcagctgccagcatggtgctctgccaggacaggtttccctgaaggaagctgctcacactgagatgagcctctcagggcaggacctcttcccaagccctgcacacccacccctgcagcccttttggctccccttttccctgtgcctcagcactcctttcctggttgcagataacgaactaaggttgcctaaagggcagatctgccctctccatgtcttcgtcctggcaaacagggtccttagagattgaaatttcaaactatctctagtttttcaatggaaatatatcagctagggaaaaaccatcaagctcattattattttttgatcttcagttgtatttttgtgaatattttaatacatctttttcaatttctgaa

SEQ ID NO: 436604 - DNA, 3758 bp, Homo sapiens
gcttcggtgcagagctggagagccgcggctgggaccggagtggggagcgcggcgtggaggtgccacccggcgcgggtggcggagagatcagaagcctcttccccaagccgagccaacctcagcggggacccgggctcagggacgcggcggcggcggcggcgactgcagtggctggacgatggcagcgtccgccggagccggggcggtgattgcagccccagacagccggcgctggctgtggtcggtgctggcggcggcgcttgggctcttgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgtttttccactactcccaagggcaagtgtaccttgggaattatccaccatttaaagacagaatcagctgggctggagaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaagagaatttgcctgtgtttccagtttgggtagtggtgggcatagttactgctgtggtcctaggtctcactctgctcatcagcatgattctggctgtcctctatagaaggaaaaactctaaacgggattacactggctgcagtacatcagagagtttgtcaccagttaagcaggctcctcggaagtccccctccgacactgagggtcttgtaaagagtctgccttctggatctcaccagggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatggtttgccttaatggagacaatagcagatcctgtagtatttccagtagacatggccttttaatctaagggcttaagactgattagtcttagcatttactgtagttggaggatggagatgctatgatggaagcatacccagggtggcctttagcacagtatcagtaccatttatttgtctgccgcttttaaaaaatacccattggctatgccacttgaaaacaatttgagaagtttttttgaagtttttctcactaaaatatggggcaattgttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggttttattctttgctgatgtcctttctgcttgaaataacagtcaccatacagctaaaggagaggagtttctttccttctaagtaggcagaaatggtatcattatgttgccgctctccaatctcccagagctcgctctctagagaatcaccttctttcgcttttttttttttttttgaggtagagtctcactatgttgcccagactagccttgaactcttgggctcaagtgattctccctcctcagcctcccgagtagctggaacgaactatagttgcaccactgcagctggcaagaatcaccttctttataaagcgtcagtcatgcttccagcaagaggcagcatcagtcatggctttataacagcttcatggtgcctcaaagactgttgaggttaatgagagcctagattagacagtttggctgtccttccctaaaacttgttttctcctattcactactccccaccgcacttaaaatctatgagtttttactttttactgggaatggaaagtgtggtgaagatcattcaacacttatgttgtcatttctcccattttctgaatttttttttaaatttccccccttttaaaattgttcgaaagcccacagttatggaaagaattactgtctagatggtctgcagaacgtgtttggggtgagtgggagtgaggggcaatgttactttttctccctgtagtttggagtccattatgagctgctgctttttcttctcatcttgtcatcttctggggatgtttgaaggctgagttccaacagaattcacaaagggaataaaacaggattgagattttgaggtgtgcacaaggtggtaagataaagggcatatgagcttcaaaactaatgctgttgcatacatgaagccttttgttttttgaggagctatttttgttattcttgtaacgctccaccttacatgccacgtctgtgtgagtcaacagggatcaggtttggtcaccacacatgtctgaagctgggcagcgtctgctctgtgttctgtgtggaatggagaaaaaaacgcctgccctgctgccttccatgttcataggcccagcccaagagagtgacacacagtgctggccctgagacatttccacaaagtggtcaactctgccttgcatcctaaaactttttgggcatctattttgaaaactataggagcctttggaaggcctcttatgtttggaggggaagggtgttgagattgtcaccatccttcaagctgagactcctggtgagcctttgccaccatgaaaaccacatagctgaccagggctgtgcttgaggtacagaggacacacatcgtagacaggcctgtgtcatgtttccttacagtcgttttttacagagaaaaggggcattgttttttcactgctttctcaacagttcctgtgaataaatgaaacatttcggagctccctgagagcaagagccttcacttcttcttgcggtgccgggaccatgtgttggtgaagctggtgctgtgggggccactcactcgaatgacacctggaggcctgttcctcccttaccactcccttccccagcccgacttcttggcctcctgcccaaccagacacctcaaactctgtcagtgccctggcattctggcagagaatcctcaccagttctcaccaaccttccccccaggcaagggcagctgccagcatggcactcctttcctggttgcagataacgaactaaggttgcctaaagggcagatctgccctctccatgtcttcgtcctggcaaacagggtcgtcttaaaattatgcgctaattctgtatgggagcactcaaaaggcattacttagagattgaaatttcaaactatctctagtttttcaatggaaatatatcagctagggaaaaaccatcaagctcattattattttttgatcttcagttgtatttttgtgaatattttaatacatctttttcaatttctgaa

SEQ ID NO: 436605 - DNA, 3667 bp, Homo sapiens
gcttcggtgcagagctggagagccgcggctgggaccggagtggggagcgcggcgtggaggtgccacccggcgcgggtggcggagagatcagaagcctcttccccaagccgagccaacctcagcggggacccgggctcagggacgcggcggcggcggcggcgactgcagtggctggacgatggcagcgtccgccggagccggggcggtgattgcagccccagacagccggcgctggctgtggtcggtgctggcggcggcgcttgggctcttgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgtttttccactactcccaagggcaagtgtaccttgggaattatccaccatttaaagacagaatcagctgggctggagaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaagagaatttgcctgtgtttccagtttgggtagtggtgggcatagttactgctgtggtcctaggtctcactctgctcatcagcatgattctggctgtcctctatagaaggaaaaactctaaacgggattacactggctgcagtacatcagagagtttgtcaccagttaagcaggctcctcggaagtccccctccgacactgagggtcttgtaaagagtctgccttctggatctcaccagggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatggtttgccttaatggagacaatagcagatcctgtagtatttccagtagacatggccttttaatctaagggcttaagactgattagtcttagcatttactgtagttggaggatggagatgctatgatggaagcatacccagggtggcctttagcacagtatcagtaccatttatttgtctgccgcttttaaaaaatacccattggctatgccacttgaaaacaatttgagaagtttttttgaagtttttctcactaaaatatggggcaattgttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggttttattctttgctgatgtcctttctgcttgaaataacagtcaccatacagctaaaggagaggagtttctttccttctaagtaggcagaaatggtatcattatgttgccgctctccaatctcccagagctcgctctctagagaatcaccttctttcgcttttttttttttttttgaggtagagtctcactatgttgcccagactagccttgaactcttgggctcaagtgattctccctcctcagcctcccgagtagctggaacgaactatagttgcaccactgcagctggcaagaatcaccttctttataaagcgtcagtcatgcttccagcaagaggcagcatcagtcatggctttataacagcttcatggtgcctcaaagactgttgaggttaatgagagcctagattagacagtttggctgtccttccctaaaacttgttttctcctattcactactccccaccgcacttaaaatctatgagtttttactttttactgggaatggaaagtgtggtgaagatcattcaacacttatgttgtcatttctcccattttctgaatttttttttaaatttccccccttttaaaattgttcgaaagcccacagttatggaaagaattactgtctagatggtctgcagaacgtgtttggggtgagtgggagtgaggggcaatgttactttttctccctgtagtttggagtccattatgagctgctgctttttcttctcatcttgtcatcttctggggatgtttgaaggctgagttccaacagaattcacaaagggaataaaacaggattgagattttgaggtgtgcacaaggtggtaagataaagggcatatgagcttcaaaactaatgctgttgcatacatgaagccttttgttttttgaggagctatttttgttattcttgtaacgctccaccttacatgccacgtctgtgtgagtcaacagggatcaggtttggtcaccacacatgtctgaagctgggcagcgtctgctctgtgttctgtgtggaatggagaaaaaaacgcctgccctgctgccttccatgttcataggcccagcccaagagagtgacacacagtgctggccctgagacatttccacaaagtggtcaactctgccttgcatcctaaaactttttgggcatctattttgaaaactataggagcctttggaaggcctcttatgtttggaggggaagggtgttgagattgtcaccatccttcaagctgagactcctggtgagcctttgccaccatgaaaaccacatagctgaccagggctgtgcttgaggtacagaggacacacatcgtagacaggcctgtgtcatgtttccttacagtcgttttttacagagaaaaggggcattgttttttcactgctttctcaacagttcctgtgaataaatgaaacatttcggagctccctgagagcaagagccttcacttcttcttgcggtgccgggaccatgtgttggtgaagctggtgctgtgggggccactcactcgaatgacacctggaggcctgttcctcccttaccactcccttccccagcccgacttcttggcctcctgcccaaccagacacgcactcctttcctggttgcagataacgaactaaggttgcctaaagggcagatctgccctctccatgtcttcgtcctggcaaacagggtcgtcttaaaattatgcgctaattctgtatgggagcactcaaaaggcattacttagagattgaaatttcaaactatctctagtttttcaatggaaatatatcagctagggaaaaaccatcaagctcattattattttttgatcttcagttgtatttttgtgaatattttaatacatctttttcaatttctgaa

SEQ ID NO: 436606 - DNA, 3353 bp, Homo sapiens
  misc_feature (3242)..(3242): n is a, c, g, or t
  misc_feature (3247)..(3247): n is a, c, g, or t
  misc_feature (3251)..(3251): n is a, c, g, or t
  misc_feature (3255)..(3255): n is a, c, g, or t
gcttcggtgcagagctggagagccgcggctgggaccggagtggggagcgcggcgtggaggtgccacccggcgcgggtggcggagagatcagaagcctcttccccaagccgagccaacctcagcggggacccgggctcagggacgcggcggcggcggcggcgactgcagtggctggacgatggcagcgtccgccggagccggggcggtgattgcagccccagacagccggcgctggctgtggtcggtgctggcggcggcgcttgggctcttgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgtttttccactactcccaagggcaagtgtaccttgggaattatccaccatttaaagacagaatcagctgggctggagaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaagagaatttgcctgtgtttccagtttgggtagtggtgggcatagttactgctgtggtcctaggtctcactctgctcatcagcatgattctggctgtcctctatagaaggaaaaactctaaacgggattacactggctgcagtacatcagagagtttgtcaccagttaagcaggctcctcggaagtccccctccgacactgagggtcttgtaaagagtctgccttctggatctcaccagggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatggtttgccttaatggagacaatagcagatcctgtagtatttccagtagacatggccttttaatctaagggcttaagactgattagtcttagcatttactgtagttggaggatggagatgctatgatggaagcatacccagggtggcctttagcacagtatcagtaccatttatttgtctgccgcttttaaaaaatacccattggctatgccacttgaaaacaatttgagaagtttttttgaagtttttctcactaaaatatggggcaattgttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggttttattctttgctgatgtcctttctgcttgaaataacagtcaccatacagctaaaggagaggagtttctttccttctaagtaggcagaaatggtatcattatgttgccgctctccaatctcccagagctcgctctctagagaatcaccttctttcgcttttttttttttttttgaggtagagtctcactatgttgcccagactagccttgaactcttgggctcaagtgattctccctcctcagcctcccgagtagctggaacgaactatagttgcaccactgcagctggcaagaatcaccttctttataaagcgtcagtcatgcttccagcaagaggcagcatcagtcatggctttataacagcttcatggtgcctcaaagactgttgaggttaatgagagcctagattagacagtttggctgtccttccctaaaacttgttttctcctattcactactccccaccgcacttaaaatctatgagtttttactttttactgggaatggaaagtgtggtgaagatcattcaacacttatgttgtcatttctcccattttctgaatttttttttaaatttccccccttttaaaattgttcgaaagcccacagttatggaaagaattactgtctagatggtctgcagaacgtgtttggggtgagtgggagtgaggggcaatgttactttttctccctgtagtttggagtccattatgagctgctgctttttcttctcatcttgtcatcttctggggatgtttgaaggctgagttccaacagaattcacaaagggaataaaacaggattgagattttgaggtgtgcacaaggtggtaagataaagggcatatgagcttcaaaactaatgctgttgcatacatgaagccttttgttttttgaggagctatttttgttattcttgtaacgctccaccttacatgccacgtctgtgtgagtcaacagggatcaggtttggtcaccacacatgtctgaagctgggcagcgtctgctctgtgttctgtgtggaatggagaaaaaaacgcctgccctgctgccttccatgttcataggcccagcccaagagagtgacacacagtgctggccctgagacatttccacaaagtggtcaactctgccttgcatcctaaaactttttgggcatctattttgaaaactataggagcctttggaaggcctcttatgtttggaggggaagggtgttgagattgtcaccatccttcaagctgagactcctggtgagcctttgccaccatgaaaaccacatagctgaccagggctgtgcttgaggtacagaggacacacatcgtagacaggcctgtgtcatgtttccttacagtcgttttttacagagaaaaggggcattgttttttcactgctttctcaacagttcctgtgaataaatgaaacatttcggagctccctgtaaaaaaaaaaanaaaanaaanaaanaaagaagaagaaaaagcagtggttttaataaactacctcccccagcccagtgtgatgatggtgcagggcttttcctttttgtagttcctactaccagc

SEQ ID NO: 436607 - DNA, 4146 bp, Homo sapiens
atggtggagacgtcactattcacctttgtcaaaatccataagatctacaacactaacacaaatcctaatgtaaactatggactgtggttaacaatgatgtaaccatattggctcatcaattaaaacaaacgtataacactaatgccagatgttaataataggagaaacaggttggccatgggagagtgagggaatatgagaattctaccttctattcaatgtttctgtaaacctgaaactgctctttaaaaagtctattagtttaaaaaaaaaattcaatataaccagactaataaaaatatcttaactaaaaagcaatacaaacctaaactgtcagcaattattctgtttatagtgctattctgattgaacttagctgtagaatattctgccagaaatatgtaatggcagtgaattactgtatatatctagtaactttgctgtatcttttcttgtctggcaaaaatgcacagtggtattcatgttaagtcctactttcaactacccttattcctttctcttcagtgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgtttttccactactcccaagggcaagtgtaccttgggaattatccaccatttaaagacagaatcagctgggctggagaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaagagaatttgcctgtgtttccagtttgggtagtggtgggcatagttactgctgtggtcctaggtctcactctgctcatcagcatgattctggctgtcctctatagaaggaaaaactctaaacgggattacactggctgcagtacatcagagagtttgtcaccagttaagcaggctcctcggaagtccccctccgacactgagggtcttgtaaagagtctgccttctggatctcaccagggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatggtttgccttaatggagacaatagcagatcctgtagtatttccagtagacatggccttttaatctaagggcttaagactgattagtcttagcatttactgtagttggaggatggagatgctatgatggaagcatacccagggtggcctttagcacagtatcagtaccatttatttgtctgccgcttttaaaaaatacccattggctatgccacttgaaaacaatttgagaagtttttttgaagtttttctcactaaaatatggggcaattgttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggttttattctttgctgatgtcctttctgcttgaaataacagtcaccatacagctaaaggagaggagtttctttccttctaagtaggcagaaatggtatcattatgttgccgctctccaatctcccagagctcgctctctagagaatcaccttctttcgcttttttttttttttttgaggtagagtctcactatgttgcccagactagccttgaactcttgggctcaagtgattctccctcctcagcctcccgagtagctggaacgaactatagttgcaccactgcagctggcaagaatcaccttctttataaagcgtcagtcatgcttccagcaagaggcagcatcagtcatggctttataacagcttcatggtgcctcaaagactgttgaggttaatgagagcctagattagacagtttggctgtccttccctaaaacttgttttctcctattcactactccccaccgcacttaaaatctatgagtttttactttttactgggaatggaaagtgtggtgaagatcattcaacacttatgttgtcatttctcccattttctgaatttttttttaaatttccccccttttaaaattgttcgaaagcccacagttatggaaagaattactgtctagatggtctgcagaacgtgtttggggtgagtgggagtgaggggcaatgttactttttctccctgtagtttggagtccattatgagctgctgctttttcttctcatcttgtcatcttctggggatgtttgaaggctgagttccaacagaattcacaaagggaataaaacaggattgagattttgaggtgtgcacaaggtggtaagataaagggcatatgagcttcaaaactaatgctgttgcatacatgaagccttttgttttttgaggagctatttttgttattcttgtaacgctccaccttacatgccacgtctgtgtgagtcaacagggatcaggtttggtcaccacacatgtctgaagctgggcagcgtctgctctgtgttctgtgtggaatggagaaaaaaacgcctgccctgctgccttccatgttcataggcccagcccaagagagtgacacacagtgctggccctgagacatttccacaaagtggtcaactctgccttgcatcctaaaactttttgggcatctattttgaaaactataggagcctttggaaggcctcttatgtttggaggggaagggtgttgagattgtcaccatccttcaagctgagactcctggtgagcctttgccaccatgaaaaccacatagctgaccagggctgtgcttgaggtacagaggacacacatcgtagacaggcctgtgtcatgtttccttacagtcgttttttacagagaaaaggggcattgttttttcactgctttctcaacagttcctgtgaataaatgaaacatttcggagctccctgagagcaagagccttcacttcttcttgcggtgccgggaccatgtgttggtgaagctggtgctgtgggggccactcactcgaatgacacctggaggcctgttcctcccttaccactcccttccccagcccgacttcttggcctcctgcccaaccagacacctcaaactctgtcagtgccctggcattctggcagagaatcctcaccagttctcaccaaccttccccccaggcaagggcagctgccagcatggtgctctgccaggacaggtttccctgaaggaagctgctcacactgagatgagcctctcagggcaggacctcttcccaagccctgcacacccacccctgcagcccttttggctccccttttccctgtgcctcagcactcctttcctggttgcagataacgaactaaggttgcctaaagggcagatctgccctctccatgtcttcgtcctggcaaacagggtcgtcttaaaattatgcgctaattctgtatgggagcactcaaaaggcattacttagagattgaaatttcaaactatctctagtttttcaatggaaatatatcagctagggaaaaaccatcaagctcattattattttttgatcttcagttgtatttttgtgaatattttaatacatctttttcaatttctgaa

SEQ ID NO: 436608 - DNA, 3780 bp, Homo sapiens
cagtcccagcccaagggtagctggaggcgcgcaggccggctccgctccggccccggacgatgcggcgcgcccaggatgctgccgtgcctcgtagtgctgctggcggcgctcctcagcctccgtcttggctcagacgctcatggctcacctgttgtggaagtggaagaggctgaaattgacaggaactgacggattgggaaggatagagaagtatgcgcaaggccaaacccccaacccgcaaacctcatcatccacccacttctagatgagccggacagagctgcccagccctccgtctgtgtggtttgaagcagaatttttccaccacatcctccactggacacccatcccaaatcagtctgaaagtacctgctatgaagtggcgctcctgaggtatggaatagagtcctggaactccatctccaactgtagccagaccctgtcctatgaccttaccgcagtgaccttggacctgtaccacagcaatggctaccgggccagagtgcgggctgtggacggcagccggcactccaactggaccgtcaccaacacccgcttctctgtggatgaagtgactctgacagttggcagtgtgaacctagagatccacaatggcttcatcctcgggaagattcagctacccaggcccaagatggcccccgcgaatgacacatatgaaagcatcttcagtcacttccgagagtatgagattgccattcgcaaggtgccgggaaacttcacgttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcatctccctcaccaggcagtatttcaccgtgaccaacgtcatcatcttctttgcctttgtcctgctgctctccggagccctcgcctactgcctggccctccagctgtatgtgcggcgccgaaagaagctacccagtgtcctgctcttcaagaagcccagccccttcatcttcatcagccagcgtccctccccagagacccaagacaccatccacccgcttgatgaggaggcctttttgaaggtgtccccagagctgaagaacttggacctgcacggcagcacagacagtggctttggcagcaccaagccatccctgcagactgaagagccccagttcctcctccctgaccctcacccccaggctgacagaacgctgggaaacggggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctcggccttgggccaccacagtcccccggagcctgaggtgcctggggaagaagacccagctgctgtggcattccagggttacctgaggcagaccagatgtgctgaagagaaggcaaccaagacaggctgcctggaggaagaatcgcccttgacagatggccttggccccaaattcgggagatgcctggttgatgaggcaggcttgcatccaccagccctggccaagggctatttgaaacaggatcctctagaaatgactctggcttcctcaggggccccaacgggacagtggaaccagcccactgaggaatggtcactcctggccttgagcagctgcagtgacctgggaatatctgactggagctttgcccatgaccttgcccctctaggctgtgtggcagccccaggtggtctcctgggcagctttaactcagacctggtcaccctgcccctcatctctagcctgcagtcaagtgagtgactcgggctgagaggctgcttttgattttagccatgcctgctcctctgcctggaccaggaggagggcccctggggcagaagttaggcacgaggcagtctgggcacttttctgcaagtccactggggctggccccagccaggccctgcagggctggtcagggtgtctggggcaggaggaggccaactcactgaactagtgcagggtatgtgggtggcactgacctgttctgttgactggggccctgcagactctggcagagctgagaagggcagggaccttctccctcctaggaactctttcctgtatcataaaggattatttgctcaggggaaccatggggctttctggagttgtggtgaggccaccaggctgaagtcagctcagacccagacctccctgcttaggccactcgagcatcagagcttccagcaggaggaagggctgtaggaatggaagcttcagggccttgctgctggggtcatttttaggggaaaaaggaggatatgatggtcacatggggaacctcccctcatcgggcctctggggcaggaagcttgtcactggaagatcttaaggtatatattttctggacactcaaacacatcataatggattcactgaggggagacaaagggagccgagaccctggatggggcttccagctcagaacccatccctctggtgggtacctctggcacccatctgcaaatatctccctctctccaacaaatggagtagcatccccctggggcacttgctgaggccaagccactcacatcctcactttgctgccccaccatcttgctgacaacttccagagaagccatggttttttgtattggtcataactcagccctttgggcggcctctgggcttgggcaccagctcatgccagccccagagggtcagggttggaggcctgtgcttgtgtttgctgctaatgtccagctacagacccagaggataagccactgggcactgggctggggtccctgccttgttggtgttcagctgtgtgattttggactagccacttgtcagagggcctcaatctcccatctgtgaaataaggactccacctttaggggaccctccatgtttgctgggtattagccaagctggtcctgggagaatgcagatactgtccgtggactaccaagctggcttgtttcttatgccagaggctaacagatccaatgggagtccatggtgtcatgccaagacagtatcagacacagccccagaagggggcattatgggccctgcctccccataggccatttggactctgccttcaaacaaaggcagttcagtccacaggcatggaagctgtgaggggacaggcctgtgcgtgccatccagagtcatctcagccctgcctttctctggagcattctgaaaacagatattctggcccagggaatccagccatgacccccacccctctgccaaagtactcttaggtgccagtctggtaactgaactccctctggaggcaggcttgagggaggattcctcagggttcccttgaaagctttatttatttattttgttcatttatttattggagaggcagcattgcacagtgaaagaattctggatatctcaggagccccgaaattctagctctgactttgctgtttccagtggtatgaccttggagaagtcacttatcctcttggagcctcagtttcctcatctgcagaataatgactgacttgtctaattcgtagggatgtgaggttctgctgaggaaatgggtatgaatgtgccttgaacacaaagctctgtcaataagtgatacatgttttttattccaataaattgtcaagaccaca

SEQ ID NO: 436609 - DNA, 3033 bp, Homo sapiens
tagagttgtggcctgtagtttgccttgggccactcactgaatggttcctgacagtgggcaatggatttcatgggaccagagtcctatgtccagaatcaccgtgccccatggtgacaggccacaaacacatctctctgggcctgcagatttcaccgtgaccaacgtcatcatcttctttgcctttgtcctgctgctctccggagccctcgcctactgcctggccctccagctgtatgtgcggcgccgaaagaagctacccagtgtcctgctcttcaagaagcccagccccttcatcttcatcagccagcgtccctccccagagacccaagacaccatccacccgcttgatgaggaggcctttttgaaggtgtccccagagctgaagaacttggacctgcacggcagcacagacagtggctttggcagcaccaagccatccctgcagactgaagagccccagttcctcctccctgaccctcacccccaggctgacagaacgctgggaaacggggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctcggccttgggccaccacagtcccccggagcctgaggtgcctggggaagaagacccagctgctgtggcattccagggttacctgaggcagaccagatgtgctgaagagaaggcaaccaagacaggctgcctggaggaagaatcgcccttgacagatggccttggccccaaattcgggagatgcctggttgatgaggcaggcttgcatccaccagccctggccaagggctatttgaaacaggatcctctagaaatgactctggcttcctcaggggccccaacgggacagtggaaccagcccactgaggaatggtcactcctggccttgagcagctgcagtgacctgggaatatctgactggagctttgcccatgaccttgcccctctaggctgtgtggcagccccaggtggtctcctgggcagctttaactcagacctggtcaccctgcccctcatctctagcctgcagtcaagtgagtgactcgggctgagaggctgcttttgattttagccatgcctgctcctctgcctggaccaggaggagggcccctggggcagaagttaggcacgaggcagtctgggcacttttctgcaagtccactggggctggccccagccaggccctgcagggctggtcagggtgtctggggcaggaggaggccaactcactgaactagtgcagggtatgtgggtggcactgacctgttctgttgactggggccctgcagactctggcagagctgagaagggcagggaccttctccctcctaggaactctttcctgtatcataaaggattatttgctcaggggaaccatggggctttctggagttgtggtgaggccaccaggctgaagtcagctcagacccagacctccctgcttaggccactcgagcatcagagcttccagcaggaggaagggctgtaggaatggaagcttcagggccttgctgctggggtcatttttaggggaaaaaggaggatatgatggtcacatggggaacctcccctcatcgggcctctggggcaggaagcttgtcactggaagatcttaaggtatatattttctggacactcaaacacatcataatggattcactgaggggagacaaagggagccgagaccctggatggggcttccagctcagaacccatccctctggtgggtacctctggcacccatctgcaaatatctccctctctccaacaaatggagtagcatccccctggggcacttgctgaggccaagccactcacatcctcactttgctgccccaccatcttgctgacaacttccagagaagccatggttttttgtattggtcataactcagccctttgggcggcctctgggcttgggcaccagctcatgccagccccagagggtcagggttggaggcctgtgcttgtgtttgctgctaatgtccagctacagacccagaggataagccactgggcactgggctggggtccctgccttgttggtgttcagctgtgtgattttggactagccacttgtcagagggcctcaatctcccatctgtgaaataaggactccacctttaggggaccctccatgtttgctgggtattagccaagctggtcctgggagaatgcagatactgtccgtggactaccaagctggcttgtttcttatgccagaggctaacagatccaatgggagtccatggtgtcatgccaagacagtatcagacacagccccagaagggggcattatgggccctgcctccccataggccatttggactctgccttcaaacaaaggcagttcagtccacaggcatggaagctgtgaggggacaggcctgtgcgtgccatccagagtcatctcagccctgcctttctctggagcattctgaaaacagatattctggcccagggaatccagccatgacccccacccctctgccaaagtactcttaggtgccagtctggtaactgaactccctctggaggcaggcttgagggaggattcctcagggttcccttgaaagctttatttatttattttgttcatttatttattggagaggcagcattgcacagtgaaagaattctggatatctcaggagccccgaaattctagctctgactttgctgtttccagtggtatgaccttggagaagtcacttatcctcttggagcctcagtttcctcatctgcagaataatgactgacttgtctaattcgtagggatgtgaggttctgctgaggaaatgggtatgaatgtgccttgaacacaaagctctgtcaataagtgatacatgttttttattccaataaattgtcaagaccaca

SEQ ID NO: 436610 - DNA, 501 bp, Homo sapiens
atccacaatggcttcatcctcgggaagattcagctacccaggcccaagatggcccccgcgaatgacacatatgaaagcatcttcagtcacttccgagagtatgagattgccattcgcaaggtgccgggaaacttcacggtatggggttccccaaggccccagggccagaactcccttggcttccctgtcccctgggctggaagcacccttgtgtgccattgggaactttgcttatggactaaagggagggtctgggatggtgggtgggcagaggagggagtagaaaccacctcagccctcagagctatgctcttgtgagatgctcctcaaaggaattgcctactagggcaattgggcaccccagagcccttgtagatgaagcaataaggctctgagaggctgtgtaacctaccagagggcgcccctgttatgggagagctggcatctgcaaaatccaccctctctcctctccaccactgttgattccagccccttctggga

SEQ ID NO: 436611 - DNA, 3650 bp, Homo sapiens
cagtcccagcccaagggtagctggaggcgcgcaggccggctccgctccggccccggacgatgcggcgcgcccaggatgctgccgtgcctcgtagtgctgctggcggcgctcctcagcctccgtcttggctcagacgctcatgggacagagctgcccagccctccgtctgtgtggtttgaagcagaatttttccaccacatcctccactggacacccatcccaaatcagtctgaaagtacctgctatgaagtggcgctcctgaggtatggaatagagtcctggaactccatctccaactgtagccagaccctgtcctatgaccttaccgcagtgaccttggacctgtaccacagcaatggctaccgggccagagtgcgggctgtggacggcagccggcactccaactggaccgtcaccaacacccgcttctctgtggatgaagtgactctgacagttggcagtgtgaacctagagatccacaatggcttcatcctcgggaagattcagctacccaggcccaagatggcccccgcgaatgacacatatgaaagcatcttcagtcacttccgagagtatgagattgccattcgcaaggtgccgggaaacttcacgttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcatctccctcaccaggcagtatttcaccgtgaccaacgtcatcatcttctttgcctttgtcctgctgctctccggagccctcgcctactgcctggccctccagctgtatgtgcggcgccgaaagaagctacccagtgtcctgctcttcaagaagcccagccccttcatcttcatcagccagcgtccctccccagagacccaagacaccatccacccgcttgatgaggaggcctttttgaaggtgtccccagagctgaagaacttggacctgcacggcagcacagacagtggctttggcagcaccaagccatccctgcagactgaagagccccagttcctcctccctgaccctcacccccaggctgacagaacgctgggaaacggggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctcggccttgggccaccacagtcccccggagcctgaggtgcctggggaagaagacccagctgctgtggcattccagggttacctgaggcagaccagatgtgctgaagagaaggcaaccaagacaggctgcctggaggaagaatcgcccttgacagatggccttggccccaaattcgggagatgcctggttgatgaggcaggcttgcatccaccagccctggccaagggctatttgaaacaggatcctctagaaatgactctggcttcctcaggggccccaacgggacagtggaaccagcccactgaggaatggtcactcctggccttgagcagctgcagtgacctgggaatatctgactggagctttgcccatgaccttgcccctctaggctgtgtggcagccccaggtggtctcctgggcagctttaactcagacctggtcaccctgcccctcatctctagcctgcagtcaagtgagtgactcgggctgagaggctgcttttgattttagccatgcctgctcctctgcctggaccaggaggagggcccctggggcagaagttaggcacgaggcagtctgggcacttttctgcaagtccactggggctggccccagccaggccctgcagggctggtcagggtgtctggggcaggaggaggccaactcactgaactagtgcagggtatgtgggtggcactgacctgttctgttgactggggccctgcagactctggcagagctgagaagggcagggaccttctccctcctaggaactctttcctgtatcataaaggattatttgctcaggggaaccatggggctttctggagttgtggtgaggccaccaggctgaagtcagctcagacccagacctccctgcttaggccactcgagcatcagagcttccagcaggaggaagggctgtaggaatggaagcttcagggccttgctgctggggtcatttttaggggaaaaaggaggatatgatggtcacatggggaacctcccctcatcgggcctctggggcaggaagcttgtcactggaagatcttaaggtatatattttctggacactcaaacacatcataatggattcactgaggggagacaaagggagccgagaccctggatggggcttccagctcagaacccatccctctggtgggtacctctggcacccatctgcaaatatctccctctctccaacaaatggagtagcatccccctggggcacttgctgaggccaagccactcacatcctcactttgctgccccaccatcttgctgacaacttccagagaagccatggttttttgtattggtcataactcagccctttgggcggcctctgggcttgggcaccagctcatgccagccccagagggtcagggttggaggcctgtgcttgtgtttgctgctaatgtccagctacagacccagaggataagccactgggcactgggctggggtccctgccttgttggtgttcagctgtgtgattttggactagccacttgtcagagggcctcaatctcccatctgtgaaataaggactccacctttaggggaccctccatgtttgctgggtattagccaagctggtcctgggagaatgcagatactgtccgtggactaccaagctggcttgtttcttatgccagaggctaacagatccaatgggagtccatggtgtcatgccaagacagtatcagacacagccccagaagggggcattatgggccctgcctccccataggccatttggactctgccttcaaacaaaggcagttcagtccacaggcatggaagctgtgaggggacaggcctgtgcgtgccatccagagtcatctcagccctgcctttctctggagcattctgaaaacagatattctggcccagggaatccagccatgacccccacccctctgccaaagtactcttaggtgccagtctggtaactgaactccctctggaggcaggcttgagggaggattcctcagggttcccttgaaagctttatttatttattttgttcatttatttattggagaggcagcattgcacagtgaaagaattctggatatctcaggagccccgaaattctagctctgactttgctgtttccagtggtatgaccttggagaagtcacttatcctcttggagcctcagtttcctcatctgcagaataatgactgacttgtctaattcgtagggatgtgaggttctgctgaggaaatgggtatgaatgtgccttgaacacaaagctctgtcaataagtgatacatgttttttattccaataaattgtcaagaccaca

SEQ ID NO: 436612 - DNA, 2265 bp, Homo sapiens
cagtcccagcccaagggtagctggaggcgcgcaggccggctccgctccggccccggacgatgcggcgcgcccaggatgctgccgtgcctcgtagtgctgctggcggcgctcctcagcctccgtcttggctcagacgctcatgggacagagctgcccagccctccgtctgtgtggtttgaagcagaatttttccaccacatcctccactggacacccatcccaaatcagtctgaaagtacctgctatgaagtggcgctcctgaggtatggaatagagtcctggaactccatctccaactgtagccagaccctgtcctatgaccttaccgcagtgaccttggacctgtaccacagcaatggctaccgggccagagtgcgggctgtggacggcagccggcactccaactggaccgtcaccaacacccgcttctctgtggatgaagtgactctgacagttggcagtgtgaacctagagatccacaatggcttcatcctcgggaagattcagctacccaggcccaagatggcccccgcgaatgacacatatgaaagcatcttcagtcacttccgagagtatgagattgccattcgcaaggtgccgggaaacttcacgttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcatctccctcaccaggcagtatttcaccgtgaccaacgtcatcatcttctttgcctttgtcctgctgctctccggagccctcgcctactgcctggccctccagctgtatgtgcggcgccgaaagaagctacccagtgtcctgctcttcaagaagcccagccccttcatcttcatcagccagcgtccctccccagagacccaagacacctcccctcatcgggcctctggggcaggaagcttgtcactggaagatcttaaggtatatattttctggacactcaaacacatcataatggattcactgaggggagacaaagggagccgagaccctggatggggcttccagctcagaacccatccctctggtgggtacctctggcacccatctgcaaatatctccctctctccaacaaatggagtagcatccccctggggcacttgctgaggccaagccactcacatcctcactttgctgccccaccatcttgctgacaacttccagagaagccatggttttttgtattggtcataactcagccctttgggcggcctctgggcttgggcaccagctcatgccagccccagagggtcagggttggaggcctgtgcttgtgtttgctgctaatgtccagctacagacccagaggataagccactgggcactgggctggggtccctgccttgttggtgttcagctgtgtgattttggactagccacttgtcagagggcctcaatctcccatctgtgaaataaggactccacctttaggggaccctccatgtttgctgggtattagccaagctggtcctgggagaatgcagatactgtccgtggactaccaagctggcttgtttcttatgccagaggctaacagatccaatgggagtccatggtgtcatgccaagacagtatcagacacagccccagaagggggcattatgggccctgcctccccataggccatttggactctgccttcaaacaaaggcagttcagtccacaggcatggaagctgtgaggggacaggcctgtgcgtgccatccagagtcatctcagccctgcctttctctggagcattctgaaaacagatattctggcccagggaatccagccatgacccccacccctctgccaaagtactcttaggtgccagtctggtaactgaactccctctggaggcaggcttgagggaggattcctcagggttcccttgaaagctttatttatttattttgttcatttatttattggagaggcagcattgcacagtgaaagaattctggatatctcaggagccccgaaattctagctctgactttgctgtttccagtggtatgaccttggagaagtcacttatcctcttggagcctcagtttcctcatctgcagaataatgactgacttgtctaattcgtagggatgtgaggttctgctgaggaaatgggtatgaatgtgccttgaacacaaagctctgtcaataagtgatacatgttttttattccaataaattgtcaagaccaca

SEQ ID NO: 436613 - DNA, 798 bp, Homo sapiens
tctaaatctatcatcaagttactgtcagtgctatttccataagatgataacttctttcatctgtactgccactaccctctttacctcttacctggaacatgatgatggccgcctcatttctgctggtgtctgcctctattccacttcacccagagcggccaagagtcgtatgtgtctgcttaaaatcttttaatggttttccatagcacttagattccaaactcccccacatggttcacaagggccagaataatctggcttctgcctgcctctctgaccctcctgctgcttttgttcacggccctccagtcacattcacttttttttaggccccagaaggtagcaagctctttcccacctctggaacttttttcgagatggagtcttgctctgtcacccaggctggagtgcagtgactcaatctttgctcactgcaacctccgcctcccaggttcaagtgattctcctgcctcagcctcccgactagctgggattacaggcgcccgccaccaggcccagctaatttttgtatttttagtagagacaggttccaccatgttggccagtctggtcttgaactcctgacctcgtgatctgcccacctcggcctcccaaagtgctgggattacaggtgtgagccaccatctggaacttttttatatactgtttcctgtatccatagcactctggcaagcctagcctttttctcatccttcaggatatttgttgaatgaataagaggcagcaaaggggatggggcaaggaggaatgtatcctgagtgcatccacaaaggtctc

SEQ ID NO: 436614 - DNA, 1577 bp, Homo sapiens
aaggaagccctgcgggaggccgtgtttgtcacttctgaagccagcctgaaaaatctctgccagatgtcccaggccgtactggatgaggatctcttcaacttcctgcaggcccactggttcacctgtgaactgctgtggtacatgcatgttaggaagggcctgcttgcgtgtaacacctacatggacagcctagacattgtcaccagcaaggtgtcaagcctctttcgggaacagcagtcgctgctggactgcatcctctgctttgtggattacatagacttctttaataccaaaggcttgaagaacttgcccacacctcctcccaaattaaagagagctcggccggcaagcatgccactgaagtccaagaaggcttttggaatctgtggagagagccttaccagcctccctgcagaagagaccaagccagacgcacagcaggtacaggtacagcagcagtcacaagtgccgccctcgcaggttggcatgctggacaccttgcaccagagtggctctgaactagcctacaagctgtgccacaatgagtgggaggtggtacagaactccacccacctggtggacatggctggctcttcagtggacgttcagctgctagaggactctcaccaggttagcaaagatggctgtagctgcagctgttcctttcaacaatggtaccacctgccatgccgacacattttggctctgctgcacaccagccagcagccggttggtgaagccatggtgtgccgccggtggcagaagaagtaccagtacctccttgggcccaatggggagctccaggatcgtggtatggtcccaaacacaggccagcctgagaagcaaggacggaacgacatgattcaggacctaagcagggagttagcaaacctgctcatgcagaccgaggggccagagctggaggaacgctactccaccctgcgcaagattgtggatatctgggctggcccctcccagccatctgagctctttcagcagccaggagactttaaggacgtgggccgcctccctttcctctggggaaagcaagaagaaggggagggattccctcctgctacagctgtgatgcattattgaagcactttagctgaagcattggaccacaaacacttctccttggaagtgtgagagtttaaagtgggcaggacatactagggtttagcattttagccaatgtcttcctaggtggggctaggaatattgttacagtagagaggaagggaactccactgtgtgacagtcctttcaatctgccccttttcagccctacttttggcattccttgggagcctcagttgttgttcaaggccaaagttatctccgtgctgcaaggtcaccctcttcctcccccagcccctgagatcagatcttatttgctctgcaaagatgaatccctgcctcaggttagggtgagacaaaatcggtctggtaaaagggcctgttttcagggacaaagggaatgaggatgatctttggctgttgctgctctttatgaagaatcttatttgtaactttttattcatattaaagttgtttttaataaaattaaaaaaaaa

SEQ ID NO: 436615 - DNA, 516 bp, Homo sapiens
  misc_feature (15)..(16): n is a, c, g, or t
  misc_feature (39)..(39): n is a, c, g, or t
agaggagaaggagannaaggaaagggaagggaagatganaaaaagggcagaaatagagccaacgtaggtaggagaagtaatcacaggtggtcagcgagcattcaaatctatgaaaactacctcggacaggagcagagaacaaacaaatacaagaagcaagcacatggagaaactagaagtagaccctagcaagcactcattccctgatgtgactaacatagttcaagagaaaaaacacacacccagaagacgacctgaacccaaaattataccaagtgaggaagacccaacctttgaagacaaccctgaagtgcctccgctgatttgaaacatctggctgcgttgccattggctgagacccaccaggtccagttttggttggtgtagagaccatatgcatattattcctgggataaacacagagttatttgtcaatatcgctgctccagtgttttaactcttactttgcatagtaatatccttaagatagcttaaaattaaaatgtatgtcttaaa

SEQ ID NO: 436616 - DNA, 3020 bp, Homo sapiens
gaattccgggcccccctcaaaagaagtgaagacattagaatgatgagaacagtccattgtaggatagacccaaatttaatagcttaaagaattgaggaagttggatccttttcaaagcgtacaacaagaatccaaactatatcagaagacagagagaagagagcaataaaatgccagatcggttactctaaattaacccaaactgtgaacagcacacagagaaaaatcaagccctttccctaagaactatgaagatacagcacaaatttacaggtatgagatcaagaaagctaaggcaggatgggagattgcagcttcaagagacatcaaaggtaacattctttaattatacaagaaaaaggaggagggccgaggataatgttgcctctattaagaaagcgggagggaaagctgttagcagatggctatgaaatggcaagagttgctgtttctcatgctttactctaggagggaaggaaggaaggaaacagggagggaaaggacggagggaaagaaatcacaagcaactactaaaaaagtgccatttgggtgggtgccaaattagtaaagataaataattacatggaatctttaagcaactggattcatgatcctgaactgagttgcagatggggcctcccatcaacatggatcagacgcatacttggatgctaagttgggaagatgttaccaaaatatgaattgcctagaggctgttgaagacaagatacatcactgaaatttggaaaaaggcaaacaaacccgggagcaggggtgaagggtgaaaagcgtcattcgaggtccgggtccggcttgcggggtcagcgaactggagaggcgccatgggctggatcacagaagatcttattagacggaatgctgaacacaacgactgtgtcattttttccctggaggaactctcgttgcatcagcaagaaatagaaagactagaacacattgataaatggtgccgggatttaaaaattctctatcttcaaaataatcttattgggaaaattgaaaatgttagcaaactcaagaaacttgaatatttgaatttagctttaaacaacattgaaaaaatagaaaacttggaaggatgtgaagagctggcaaaacttgacctgactgtgaatttcattggagagctgagcagcattaaaaacttgcagcacaatatccatctgaaggagctctttctcatggggaacccatgtgcttcctttgaccactatagggagttcgtggtagcaactcttccacaattaaagtggttggatggtaaagaaatagagccttcagaaaggattaaggcattgcaggactattcagtaattgaaccacaaatcagagagcaggaaaaagatcactgtcttaaacgagccaaactcaaggaagaggctcagaggaaacaccaagaagaggataaaaatgaagacaagagaagtaacgcaggctttgatggacgttggtacacagacatcaatgctactctttcctctttagagagcaaagaccacctacaggcaccagacacagaggaacacaacacaaagaaattagacaacagtgaagatgacttggaattctggaataagccctgtttgtttactcctgaatcaagattggaaactcttagacacatggaaaaacaacggaagaaacaggaaaaattaagtgaaaaaaagaagaaagtgaaaccacccaggactttgatcactgaagatgggaaagccctaaatgtgaatgagcccaaaattgacttctctttgaaagataacgaaaagcagatcatcctggaccttgctgtctataggtatatggatacctctttaatcgatgttgatgtgcaaccaacttacgtgcgagtaatgatcaaaggaaagccatttcagcttgtccttcctgcagaagtgaaacccgatagtagttctgctaaaagatctcagacaacgggtcatttggtcatctgcatgcccaaggtaggagaagtaatcacaggtggtcagcgagcattcaaatctatgaaaactacctcggacaggagcagagaacaaacaaatacaagaagcaagcacatggagaaactagaagtagaccctagcaagcactcattccctgatgtgactaacatagttcaagagaaaaaacacacacccagaagacgacctgaacccaaaattataccaagtgaggaagacccaacctttgaagacaaccctgaagtgcctccgctgatttgaaacatctggctgcgttgccattggctgagacccaccaggtccagttttggttggtgtagagaccatatgcatattattcctgggataaacacagagttatttgtcaatatcgctgctccagtgttttaactcttactttgcatagtaatatccttaagatagcttaaaattaaaatgtatgtcttaaatgctataactcatcatttacctataataaagggttggtattgaaaatgtttagtaagatcatagaactattgcataaaacactgattataaatactgtctacttatgcaaagtattaattcatagataaaaggactgagtattaaattggtacttcagcaaagtggtcaagcttagaagttaaaactgtaatttcagacccaattggaatactttaatatgattttaaacagcatttccattttccttcccatgatgtgtctgctttctctggtggcatggtataatggcaagaatatgagttttgaaaccagacactctatatttggattccagctcaatcactttgtaaagaccttcagcaagtcctttaattctctgagccttagtggcttcatgtataatctgggaataataacacttgcctcacaggtttgtctcaagataaactgcagaaagcacttagtacagtgtcagccatacatttagagcctcttctctctctccttcttccctttctcctctctcttctcctccctttctcctgtctctcctcctccctgctccttcttcccctccctccccaatta

SEQ ID NO: 436617 - DNA, 2238 bp, Homo sapiens
agcgggttgccatggctcctgaattccgacggggacgcgctgaggagcaggggtgaagggtgaaaagcgtcattcgaggtccgggtccggcttgcggggtcagcgaactggagaggcgccatgggctggatcacagaagatcttattagacggaatgctgaacacaacgactgtgtcattttttccctggaggaactctcgttgcatcagcaagaaatagaaagactagaacacattgataaatggtgccgggatttaaaaattctctatcttcaaaataatcttattgggaaaattgaaaatgttagcaaactcaagaaacttgaatatttgaatttagctttaaacaacattgaaaaaatagaaaacttggaaggatgtgaagagctggcaaaacttgacctgactgtgaatttcattggagagctgagcagcattaaaaacttgcagcacaatatccatctgaaggagctctttctcatggggaacccatgtgcttcctttgaccactatagggagttcgtggtagcaactcttccacaattaaagtggttggatggtaaagaaatagagccttcagaaaggattaaggcattgcaggactattcagtaattgaaccacaaatcagagagcaggaaaaagatcactgtcttaaacgagccaaactcaaggaagaggctcagaggaaacaccaagaagaggataaaaatgaagacaagagaagtaacgcaggctttgatggacgttggtacacagacatcaatgctactctttcctctttagagagcaaagaccacctacaggcaccagacacagaggaacacaacacaaagaaattagacaacagtgaagatgacttggaattctggaataagccctgtttgtttactcctgaatcaagattggaaactcttagacacatggaaaaacaacggaagaaacaggaaaaattaagtgaaaaaaagaagaaagtgaaaccacccaggactttgatcactgaagatgggaaagccctaaatgtgaatgagcccaagtatatggatacctctttaatcgatgttgatgtgcaaccaacttacgtgcgagtaatgatcaaaggaaagccatttcagcttgtccttcctgcagaagtgaaacccgatagtagttctgctaaaagatctcagacaacgggtcatttggtcatctgcatgcccaaggtaggagaagtaatcacaggtggtcagcgagcattcaaatctatgaaaactacctcggacaggagcagagaacaaacaaatacaagaagcaagcacatggagaaactagaagtagaccctagcaagcactcattccctgatgtgactaacatagttcaagagaaaaaacacacacccagaagacgacctgaacccaaaattataccaagtgaggaagacccaacctttgaagacaaccctgaagtgcctccgctgatttgaaacatctggctgcgttgccattggctgagacccaccaggtccagttttggttggtgtagagaccatatgcatattattcctgggataaacacagagttatttgtcaatatcgctgctccagtgttttaactcttactttgcatagtaatatccttaagatagcttaaaattaaaatgtatgtcttaaatgctataactcatcatttacctataataaagggttggtattgaaaatgtttagtaagatcatagaactattgcataaaacactgattataaatactgtctacttatgcaaagtattaattcatagataaaaggactgagtattaaattggtacttcagcaaagtggtcaagcttagaagttaaaactgtaatttcagacccaattggaatactttaatatgattttaaacagcatttccattttccttcccatgatgtgtctgctttctctggtggcatggtataatggcaagaatatgagttttgaaaccagacactctatatttggattccagctcaatcactttgtaaagaccttcagcaagtcctttaattctctgagccttagtggcttcatgtataatctgggaataataacacttgcctcacaggtttgtctcaagataaactgcagaaagcacttagtacagtgtcagccatacatttagagcctcttctctctctccttcttccctttctcctctctcttctcctccctttctcctgtctctcctcctccctgctccttcttcccctccctccccaatta

SEQ ID NO: 436618 - DNA, 1415 bp, Homo sapiens
agcgggttgccatggctcctgaattccgacggggacgcgctgaggagcaggggtgaagggtgaaaagcgtcattcgaggtccgggtccggcttgcggggtcagcgaactggagaggcgccatgggctggatcacagaagatcttattagacggaatgctgaacacaacgactgtgtcattttttccctggaggaactctcgttgcatcagcaagaaatagaaagactagaacacattgataaatggtgccgggatttaaaaattctctatcttcaaaataatcttattgggaaaattgaaaatgttagcaaactcaagaaacttgaatatttgaatttagctttaaacaacattgaaaaaatagaaaacttggaaggatgtgaagagctggcaaaacttgacctgactgtgaatttcattggagagctgagcagcattaaaaacttgcagcacaatatccatctgaaggagctctttctcatggggaacccatgtgcttcctttgaccactatagggagttcgtggtagcaactcttccacaattaaagtggttggatggtaaagaaatagagccttcagaaaggattaaggcattgcaggactattcagtaattgaaccacaaatcagagagcaggaaaaagatcactgtcttaaacgagccaaactcaaggaagaggctcagaggaaacaccaagaagaggataaaaatgaagacaagagaagtaacgcaggctttgatggacgttggtacacagacatcaatgctactctttcctctttagagagcaaagaccacctacaggcaccagacacagaggaacacaacacaaagaaattagacaacagtgaagatgacttggaattctggaataagccctgtttgtttactcctgaatcaagattggaaactcttagacacatggaaaaacaacggaagaaacaggaaaaattaagtgaaaaaaagaagaaagtgaaaccacccaggactttgatcactgaagatgggaaagccctaaatgtgaatgagcccaaaattgacttctctttgaaagataacgaaaagcagatcatcctggaccttgctgtctataggtatatggatacctctttaatcgatgttgatgtgcaaccaacttacgtgcgagtaatgatcaaaggaaagccatttcagcttgtccttcctgcagaagtgaaacccgatagtagttctgctaaaagatctcagacaacgggtcatttggtcatctgcatgcccaagggtgccaaccaattgatgagaaaagctctactgtcactgtttatgagtcttaaacaactgcagcattcttttccccttttcctttatgtttttaatctgtctaaatttttcacatgaaaataataataaatggcttatgaggaaaaagcatttta

SEQ ID NO: 436619 - DNA, 1753 bp, Homo sapiens
agcgggttgccatggctcctgaattccgacggggacgcgctgaggagcaggggtgaagggtgaaaagcgtcattcgaggtccgggtccggcttgcggggtcagcgaactggagaggcgccatgggctggatcacagaagatcttattagacggaatgctgaacacaacgactgtgtcattttttccctggaggaactctcgttgcatcagcaagaaatagaaagactagaacacattgataaatggtgccgggatttaaaaattctctatcttcaaaataatcttattgggaaaattgaaaatgttagcaaactcaagaaacttgaatatttgaatttagctttaaacaacattgaaaaaatagaaaacttggaaggatgtgaagagctggcaaaacttgacctgactgtgaatttcattggagagctgagcagcattaaaaacttgcagcacaatatccatctgaaggagctctttctcatggggaacccatgtgcttcctttgaccactatagggagttcgtggtagcaactcttccacaattaaagtggttggatggtaaagaaatagagccttcagaaaggattaaggcattgcaggactattcagtaattgaaccacaaatcagagagcaggaaaaagatcactgtcttaaacgagccaaactcaaggaagaggctcagaggaaacaccaagaagaggataaaaatgaagacaagagaagtaacgcaggctttgatggacgttggtacacagacatcaatgctactctttcctctttagagagcaaagaccacctacaggcaccagacacagaggaacacaacacaaagaaattagacaacagtgaagatgacttggaattctggaataagccctgtttgtttactcctgaatcaagattggaaactcttagacacatggaaaaacaacggaagaaacaggaaaaattaagtgaaaaaaagaagaaagtgaaaccacccaggactttgatcactgaagatgggaaagccctaaatgtgaatgagcccaaaattgacttctctttgaaagataacgaaaagcagatcatcctggaccttgctgtctataggtatatggatacctctttaatcgatgttgatgtgcaaccaacttacgtgcgagtaatgatcaaaggaaagccatttcagcttgtccttcctgcagaagtgaaacccgatagtagttctgctaaaagatctcagacaacgggtcatttggtcatctgcatgcccaaggtaggagaagtaatcacaggtggtcagcgagcattcaaatctatgaaaactacctcggacaggagcagagaacaaacaaatacaagaagcaagcacatggagaaactagaagtagaccctagcaagcactcattccctgatgtgactaacatagttcaagagaaaaaacacacacccagaagacgacctgaacccaaaattataccaagtgaggaagacccaacctttgaagacaaccctgaagtgcctccgctgatttgaaacatctggctgcgttgccattggctgagacccaccaggtcctgtcctggctcgtgcaacctcttcaagcataactccctccctataagtatctatcaactcagtaagtttggggctacatttcaaaacccccgtaatgagaaaagtcagttccctaagcctgattttgttgttttttgttttatatcaattaacgttaacaactgcatccactatttaattcatgaggatc

SEQ ID NO: 436620 - DNA, 1105 bp, Homo sapiens
  misc_feature (15)..(16): n is a, c, g, or t
  misc_feature (39)..(39): n is a, c, g, or t
agaggagaaggagannaaggaaagggaagggaagatganaaaaagggcagaaatagagccaacgtaggtaggagaagtaatcacaggtggtcagcgagcattcaaatctatgaaaactacctcggacaggagcagagaacaaacaaatacaagaagcaagcacatggagaaactagaagtagaccctagcaagcactcattccctgatgtgactaacatagttcaagagaaaaaacacacacccagaagacgacctgaacccaaaattataccaagtgaggaagacccaacctttgaagacaaccctgaagtgcctccgctgatttgaaacatctggctgcgttgccattggctgagacccaccaggtccagttttggttggtgtagagaccatatgcatattattcctgggataaacacagagttatttgtcaatatcgctgctccagtgttttaactcttactttgcatagtaatatccttaagatagcttaaaattaaaatgtatgtcttaaatgctataactcatcatttacctataataaagggttggtattgaaaatgtttagtaagatcatagaactattgcataaaacactgattataaatactgtctacttatgcaaagtattaattcatagataaaaggactgagtattaaattggtacttcagcaaagtggtcaagcttagaagttaaaactgtaatttcagacccaattggaatactttaatatgattttaaacagcatttccattttccttcccatgatgtgtctgctttctctggtggcatggtataatggcaagaatatgagttttgaaaccagacactctatatttggattccagctcaatcactttgtaaagaccttcagcaagtcctttaattctctgagccttagtggcttcatgtataatctgggaataataacacttgcctcacaggtttgtctcaagataaactgcagaaagcacttagtacagtgtcagccatacatttagagcctcttctctctctccttcttccctttctcctctctcttctcctccctttctcctgtctctcctcctccctgctccttcttcccctccctccccaatta

SEQ ID NO: 436621 - DNA, 1071 bp, Homo sapiens
tgtcttccagctattctactggattctagaggtgatgtttctgacagtcaggtcgtgggtaagaccagtgatgggcgtccgtcctagaggcctctgacattaaggcggggaaagcaaagaagcaagcacatggagaaactagaagtagaccctagcaagcactcattccctgatgtgactaacatagttcaagagaaaaaacacacacccagaagacgacctgaacccaaaattataccaagtgaggaagacccaacctttgaagacaaccctgaagtgcctccgctgatttgaaacatctggctgcgttgccattggctgagacccaccaggtccagttttggttggtgtagagaccatatgcatattattcctgggataaacacagagttatttgtcaatatcgctgctccagtgttttaactcttactttgcatagtaatatccttaagatagcttaaaattaaaatgtatgtcttaaatgctataactcatcatttacctataataaagggttggtattgaaaatgtttagtaagatcatagaactattgcataaaacactgattataaatactgtctacttatgcaaagtattaattcatagataaaaggactgagtattaaattggtacttcagcaaagtggtcaagcttagaagttaaaactgtaatttcagacccaattggaatactttaatatgattttaaacagcatttccattttccttcccatgatgtgtctgctttctctggtggcatggtataatggcaagaatatgagttttgaaaccagacactctatatttggattccagctcaatcactttgtaaagaccttcagcaagtcctttaattctctgagccttagtggcttcatgtataatctgggaataataacacttgcctcacaggtttgtctcaagataaactgcagaaagcacttagtacagtgtcagccatacatttagagcctcttctctctctccttcttccctttctcctctctcttctcctccctttctcctgtctctcctcctccctgctccttcttcccctccctccccaatta

SEQ ID NO: 436622 - DNA, 661 bp, Homo sapiens
aatgagtgatatgaaatctaaatctttaatttgctcatgagtggaggagaataattgccacctgatcttggggtcactgccataaacagaagggtttgcttattcagcaggatgtgactttgaggggagaagcaatctagtcttccaggagagatagtattagggcagctgcagaacagctgcaggggatccagagccgccaaggaagcaggagctggtggttgcaggcctcaagcagagtagaatcagcattcctggctattcaagtcttaggggcttaaaataaaatattcatgaaagagcatggcaagctgttttttgcaaacctctggtgtttcagacctcagatatttttgggttaggggcaatcaatgccaagtatacttgtgggtctaaaaatgaaattgctgatatattgaatttcctttggtctgggaattaatttaaaactaattttttaaagacccattttgcatggatattttaaacgcccttcatttaaaatggtcctgtaagtgtgaatttatatttgcacttattcaaacttgatattttttaaaattataagattttctgtgtttaattttgaaggtatatggatacctctttaatcgatgttgatgtgcaaccaacttacgtgcgagtaatgatcaaaggaaag

SEQ ID NO: 436623 - DNA, 736 bp, Homo sapiens
ttaactacattatcttgtatttcagaaaatgttagcaaactcaagaaacttgaatatttgaatttagctttaaacaacattgaaaaaatagaaaacttggaaggatgtgaagagctggcaaaacttgacctgactgtgaatttcattggagagctgagcagcattaaaaacttgcagcacaatatccatctgaaggagctctttctcatggggaacccatgtgcttcctttgaccactatagggagttcgtggtagcaactcttccacaattaaagtggttggatggtaaagaaatagagccttcagaaaggattaaggcattgcaggactattcagtaattgaaccacaaatcagagagcaggaaaaagatcactgtcttaaacgagccaaactcaaggaagaggctcagaggaaacaccaagaagaggataaaaatgaagacaagagaagtaacgcaggctttgatggacgttggtacacagacatcaatgctactctttcctctttagagagcaaagaccacctacaggcaccagacacagaggaacacaacacaaagaaattagacaacagtgaagatgacttggaattctggaataagccctgtttgtttactcctgaatcaagattggaaactcttagacacatggaaaaacaacggaagaaacaggaaaaattaagggattatcatacctgtcttacctaccccactgtactgttaagaaaatcagatg

SEQ ID NO: 436624 - DNA, 2298 bp, Homo sapiens
agcgggttgccatggctcctgaattccgacggggacgcgctgaggagcaggggtgaagggtgaaaagcgtcattcgaggtccgggtccggcttgcggggtcagcgaactggagaggcgccatgggctggatcacagaagatcttattagacggaatgctgaacacaacgactgtgtcattttttccctggaggaactctcgttgcatcagcaagaaatagaaagactagaacacattgataaatggtgccgggatttaaaaattctctatcttcaaaataatcttattgggaaaattgaaaatgttagcaaactcaagaaacttgaatatttgaatttagctttaaacaacattgaaaaaatagaaaacttggaaggatgtgaagagctggcaaaacttgacctgactgtgaatttcattggagagctgagcagcattaaaaacttgcagcacaatatccatctgaaggagctctttctcatggggaacccatgtgcttcctttgaccactatagggagttcgtggtagcaactcttccacaattaaagtggttggatggtaaagaaatagagccttcagaaaggattaaggcattgcaggactattcagtaattgaaccacaaatcagagagcaggaaaaagatcactgtcttaaacgagccaaactcaaggaagaggctcagaggaaacaccaagaagaggataaaaatgaagacaagagaagtaacgcaggctttgatggacgttggtacacagacatcaatgctactctttcctctttagagagcaaagaccacctacaggcaccagacacagaggaacacaacacaaagaaattagacaacagtgaagatgacttggaattctggaataagccctgtttgtttactcctgaatcaagattggaaactcttagacacatggaaaaacaacggaagaaacaggaaaaattaagtgaaaaaaagaagaaagtgaaaccacccaggactttgatcactgaagatgggaaagccctaaatgtgaatgagcccaaaattgacttctctttgaaagataacgaaaagcagatcatcctggaccttgctgtctataggtatatggatacctctttaatcgatgttgatgtgcaaccaacttacgtgcgagtaatgatcaaaggaaagccatttcagcttgtccttcctgcagaagtgaaacccgatagtagttctgctaaaagatctcagacaacgggtcatttggtcatctgcatgcccaaggtaggagaagtaatcacaggtggtcagcgagcattcaaatctatgaaaactacctcggacaggagcagagaacaaacaaatacaagaagcaagcacatggagaaactagaagtagaccctagcaagcactcattccctgatgtgactaacatagttcaagagaaaaaacacacacccagaagacgacctgaacccaaaattataccaagtgaggaagacccaacctttgaagacaaccctgaagtgcctccgctgatttgaaacatctggctgcgttgccattggctgagacccaccaggtccagttttggttggtgtagagaccatatgcatattattcctgggataaacacagagttatttgtcaatatcgctgctccagtgttttaactcttactttgcatagtaatatccttaagatagcttaaaattaaaatgtatgtcttaaatgctataactcatcatttacctataataaagggttggtattgaaaatgtttagtaagatcatagaactattgcataaaacactgattataaatactgtctacttatgcaaagtattaattcatagataaaaggactgagtattaaattggtacttcagcaaagtggtcaagcttagaagttaaaactgtaatttcagacccaattggaatactttaatatgattttaaacagcatttccattttccttcccatgatgtgtctgctttctctggtggcatggtataatggcaagaatatgagttttgaaaccagacactctatatttggattccagctcaatcactttgtaaagaccttcagcaagtcctttaattctctgagccttagtggcttcatgtataatctgggaataataacacttgcctcacaggtttgtctcaagataaactgcagaaagcacttagtacagtgtcagccatacatttagagcctcttctctctctccttcttccctttctcctctctcttctcctccctttctcctgtctctcctcctccctgctccttcttcccctccctccccaatta

SEQ ID NO: 436625 - DNA, 1709 bp, Homo sapiens
agcgggttgccatggctcctgaattccgacggggacgcgctgaggagcaggggtgaagggtgaaaagcgtcattcgaggtccgggtccggcttgcggggtcagcgaactggagaggcgccatgggctggatcacagaagatcttattagacggaatgctgaacacaacgactgtgtcattttttccctggaggaactctcgttgcatcagcaagaaatagaaagactagaacacattgataaatggtgccgggatttaaaaattctctatcttcaaaataatcttattgggaaaattgaaaatgttagcaaactcaagaaacttgaatatttgaatttagctttaaacaacattgaaaaaatagaaaacttggaaggatgtgaagagctggcaaaacttgacctgactgtgaatttcattggagagctgagcagcattaaaaacttgcagcacaatatccatctgaaggagctctttctcatggggaacccatgtgcttcctttgaccactatagggagttcgtggtagcaactcttccacaattaaagtggttggatggtaaagaaatagagccttcagaaaggattaaggcattgcaggactattcagtaattgaaccacaaatcagagagcaggaaaaagatcactgtcttaaacgagccaaactcaaggaagaggctcagaggaaacaccaagaagaggataaaaatgaagacaagagaagtaacgcaggctttgatggacgttggtacacagacatcaatgctactctttcctctttagagagcaaagaccacctacaggcaccagacacagaggaacacaacacaaagaaattagacaacagtgaagatgacttggaattctggaataagccctgtttgtttactcctgaatcaagattggaaactcttagacacatggaaaaacaacggaagaaacaggaaaaattaagtgaaaaaaagaagaaagtgaaaccacccaggactttgatcactgaagatgggaaagccctaaatgtgaatgagcccaaaattgacttctctttgaaagataacgaaaagcagatcatcctggaccttgctgtctataggtatatggatacctctttaatcgatgttgatgtgcaaccaacttacgtgcgagtaatgatcaaaggaaagccatttcagcttgtccttcctgcagaagtgaaacccgatagtagttctgctaaaagatctcagacaacgggtcatttggtcatctgcatgcccaaggtaggagaagtaatcacaggtggtcagcgagcattcaaatctatgaaaactacctcggacaggagcagagaacaaacaaatacaagaagcaagcacatggagaaactagaagtagaccctagcaagcactcattccctgatgtgactaacatagttcaagagaaaaaacacacacccagaagacgacctgaacccaaaattataccaagtgaggaagacccaacctttgaagacaaccctgaagtgcctccgctgatttgaaacatctggctgcgttgccattggctgagacccaccaggtccagttttggttggtgtagagaccatatgcatattattcctgggataaacacagagttatttgtcaatatcgctgctccagtgttttaactcttactttgcatagtaatatccttaagatagcttaaaattaaaatgtatgtcttaaa

SEQ ID NO: 436626 - DNA, 562 bp, Homo sapiens
  misc_feature (549)..(549): n is a, c, g, or t
gctggtcctagaggatcccctctatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgccttgcatccagaggggncctctagaacgcc

SEQ ID NO: 436627 - DNA, 510 bp, Homo sapiens
  misc_feature (46)..(46): n is a, c, g, or t
gtctctctctctctctctctctctctctctctctctctctctctcnccgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttggacccttcagccactacaacagaattttttaaattgacagttgcagaattgtggagtgtttttacattgatcttttgctaatgcaattagcattatgttttgcatgtatgacttaataaatccttgaatcata

SEQ ID NO: 436628 - DNA, 1105 bp, Homo sapiens
actccagtctgggcaacagagcaagactccgtctcaaaaacgcttgtcttaaggggtggcttcccccagacctacaaagtagcccagaattggaggtcttagtgtcagcaacagtgctgattttgataatgcaagtctgtacattcaaaccagtctcccagaactaggtggaagataggaacatttctgcataggagacttggaatgttctggcagcattaaaaccctgaggcccggctatgttctgggagagccctttggcaggcatcatttacagacgggtccttttcctgtatgctgtggcttcaactaggctgtgtctgagaactcggatggagcacttgaaagtgcccgtggctcccgcctgcctttgcggtaagggacagtgcagaacatctccggctgtgccagctgttgtagattctggtgggtgctgccatgggaggaggagcacgttgttgccccccctcaggatctccctgacctctgtcttcaccatcgttgaacttaacgcctgcttttgaccaggtagcgtggagtgtttcagtggcatttgtcatcgaagatatgttagaatctattgtatgcttttggatctctccggagggttaagacaaaattctaataaagaatcgataagaggttatattgatttattgttgtcctcagtctgtactaaactcaaaccaagttctcatgcattactaggttggagaaacgtacggtaaggatataacctcccggggcaaagacaagccgattgccgtatgtaaaactttcagtccacttcagtttcaagctttctctgttctctcatttcacttcgttttcctaggattttttattaagcctcaagctccttgagtgttttatatttaattcactcaaggttggggttttgcttgatgaaataaacttcattagagtgtgatagtttacccaccggcttgaattaaagcagtttgtgaactgtgatcttctcctcccaagtgaaaggaggggacagtgagagggcccctctcctggctggttggagatgcagatatggagactcctcccggaagcccacctggctgtgagccgagccggagcaggactaaccttg

SEQ ID NO: 436629 - DNA, 171 bp, Homo sapiens
  misc_feature (7)..(8): n is a, c, g, or t
  misc_feature (29)..(29): n is a, c, g, or t
gcggtcnnctactactactaaattcgcgnccgcgtcgggacccttcagccactacaacagaattttttaaattgacagttgcagaattgtggagtgtttttacattgatcttttgctaatgcaattagcattatgttttgcatgtatgacttaataaatccttgaatcata

SEQ ID NO: 436630 - DNA, 2667 bp, Homo sapiens
actccgggagcggcgcgggcgggagcggcgcgggcgggagcggccccgcccggaacctgggagcggcggcgccggcgcgggggaggggaggccggatgtgagtggagcggccatttcctgtttctctgcagttttcctcagctttgggtggtggccgctgccgggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcggcccagcgagcggccctgatgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcataaaaaaaaaaaacacacacaacaaaaaaaaaaaaaaaaaaaaaaaaaaaaaaaaaaaaaaaaaaaaaaccatgtgggccgcttgggccaagtcgactctagactcgaccaagctaatgcatgcggccgaatttcgagctaactgggccaattggccctaaggggggccgtattacaattaacgtgcccgtcgtttacaacgttgggactggaccctggcgtaacccacctactcgccttgcg

SEQ ID NO: 436631 - DNA, 2372 bp, Homo sapiens
actccgggagcggcgcgggcgggagcggcgcgggcgggagcggccccgcccggaacctgggagcggcggcgccggcgcgggggaggggaggccggatgtgagtggagcggccatttcctgtttctctgcagttttcctcagctttgggtggtggccgctgccgggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcggcccagcgagcggccctgatgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccatttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcata

SEQ ID NO: 436632 - DNA, 2762 bp, Homo sapiens
actccgggagcggcgcgggcgggagcggcgcgggcgggagcggccccgcccggaacctgggagcggcggcgccggcgcgggggaggggaggccggatgtgagtggagcggccatttcctgtttctctgcagttttcctcagctttgggtggtggccgctgccgggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcggcccagcgagcggccctgatgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcataaaaaaaaaaaaaaaaaaaaaaaaaaaaaaaaaaaaaaaaaaaaaaaaaaagagggggggcggcgcgcgccaaaaatgtcccccgcgggggggcgccccatggcgccgaccacccacacttttgctgtgtttatcacaaggggggggggcccccagatgagggagggcggcttattataacaagcaccaggcggacgagaggggcgcgcgcctgttaaacaagacgctgcggtgagtggggggaaaacgagcggccaccgacgggggaaagctgggcgggagaaggaaccccatctgcgcgggcgggcgcacacatggggccccaaccccccgcaga

SEQ ID NO: 436633 - DNA, 2598 bp, Homo sapiens
  misc_feature (2425)..(2425): n is a, c, g, or t
actccgggagcggcgcgggcgggagcggcgcgggcgggagcggccccgcccggaacctgggagcggcggcgccggcgcgggggaggggaggccggatgtgagtggagcggccatttcctgtttctctgcagttttcctcagctttgggtggtggccgctgccgggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcggcccagcgagcggccctgatgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgtgacctctttggcataatgtgcaatttgagcatttagttgtttggcatgtgttatttgacctntacattacaatctcctgttggaatttcattttaaacaaacaagaagcaaagagagcgcgcgcgggcgcgcgccgctctctatagagagtatatctcccctctcgaggaggggggccccccaagaggggctttatagcgcgcggtattacccccgagggcatttcgcccgcgaa

SEQ ID NO: 436634 - DNA, 2209 bp, Homo sapiens
  misc_feature (2196)..(2196): n is a, c, g, or t
actccgggagcggcgcgggcgggagcggcgcgggcgggagcggccccgcccggaacctgggagcggcggcgccggcgcgggggaggggaggccggatgtgagtggagcggccatttcctgtttctctgcagttttcctcagctttgggtggtggccgctgccgggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcggcccagcgagcggccctgatgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgccttgcatccagaggggncctctagaacgcc

SEQ ID NO: 436635 - DNA, 2207 bp, Homo sapiens
  misc_feature (2190)..(2190): n is a, c, g, or t
actccgggagcggcgcgggcgggagcggcgcgggcgggagcggccccgcccggaacctgggagcggcggcgccggcgcgggggaggggaggccggatgtgagtggagcggccatttcctgtttctctgcagttttcctcagctttgggtggtggccgctgccgggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcggcccagcgagcggccctgatgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgccatttccaccntgccagggtaccgagct

SEQ ID NO: 436636 - DNA, 2370 bp, Homo sapiens
actccgggagcggcgcgggcgggagcggcgcgggcgggagcggccccgcccggaacctgggagcggcggcgccggcgcgggggaggggaggccggatgtgagtggagcggccatttcctgtttctctgcagttttcctcagctttgggtggtggccgctgccgggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcggcccagcgagcggccctgatgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttgattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcata

SEQ ID NO: 436637 - DNA, 2525 bp, Homo sapiens
actccgggagcggcgcgggcgggagcggcgcgggcgggagcggccccgcccggaacctgggagcggcggcgccggcgcgggggaggggaggccggatgtgagtggagcggccatttcctgtttctctgcagttttcctcagctttgggtggtggccgctgccgggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcggcccagcgagcggccctgatgcaggccatcaagtgtgtggtggtgggagacggagctgtaggtaaaacttgcctactgatcagttacacaaccaatgcatttcctggagaatatatccctactgttctctctctcttgcccaggatggagtgctgtgatgcgatctcagctcactgcagcgtctgcctcctgggttcaagtgattctctgcctcagcctcccagctttgacaattattctgccaatgttatggtagatggaaaaccggtgaatctgggcttatgggatacagctggacaagaagattatgacagattacgccccctatcctatccgcaaacagatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcata

SEQ ID NO: 436638 - DNA, 1992 bp, Homo sapiens
actccgggagcggcgcgggcgggagcggcgcgggcgggagcggccccgcccggaacctgggagcggcggcgccggcgcgggggaggggaggccggatgtgagtggagcggccatttcctgtttctctgcagttttcctcagctttgggtggtggccgctgccgggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcggcccagcgagcggccctgatgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagggacccttcagccactacaacagaattttttaaattgacagttgcagaattgtggagtgtttttacattgatcttttgctaatgcaattagcattatgttttgcatgtatgacttaataaatccttgaatcataaaaaaaaaaaaaaaaaaaaaaaaaaaaaaaaaaaaaaaaaaaaaaaaaaatgtgtgtgggggcgccaaggcccccagaaagaactttataaaaacacacgggggggggggggggcccaagaggaagagggaaagggggacaaaagggggaccaggggaaacgggggaaacacaaggggggggggattccacaccaagaaaaaacacgggggggaaaacaagggcgtgtttggaaaaaaccacagaggaggagaaaagaggaacaaaagggggaactaaacaaggggggacacagggaggcgaaaaaaaaataccgcgggggggggagca

SEQ ID NO: 436639 - DNA, 1663 bp, Homo sapiens
actccgggagcggcgcgggcgggagcggcgcgggcgggagcggccccgcccggaacctgggagcggcggcgccggcgcgggggaggggaggccggatgtgagtggagcggccatttcctgtttctctgcagttttcctcagctttgggtggtggccgctgccgggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcggcccagcgagcggccctgatgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagggacccttcagccactacaacagaattttttaaattgacagttgcagaattgtggagtgtttttacattgatcttttgctaatgcaattagcattatgttttgcatgtatgacttaataaatccttgaatcata

SEQ ID NO: 436640 - DNA, 2865 bp, Homo sapiens
ctaaccccaccgtgcttgagatggtgtgctgggtgccgcggtgattcttggacgagcttgtgcatgcgccagcattcttcaaatgccagttataaaaagctgttgtgtgggatgtttctttccctttcaggtacaaggtatcagctggagggttgaaagtgtagcttgggaattgtgtgcatttcataaagtagcataattgcctttttccaggagaatattttagaaatctagcattttagaattcttgggcatttttaaatacaggtgaatatttgaatttggtttgacacaaaatacagaatggatgaagcatgcagatgtttggcgtgtgccccgaagcaccctctactctgtcctctgcacccaccctttgcgcctctgcgtcagccacagctgccccgggagcgagttctcctgaggccctggctgtgctgactctagggcagcgtgagggtggttgtcagctgtgaaggtgccacttacacactaagtcctccttccttgtggagggaagggctcaagtagcaaatattggagcccccgcttggtgctgggagctgtgacaggcagctcctgaagaagcagtttaattggaaccagtgaccatctaaaactgtttgtactctaaaccagattttacagaaatattggaatcatacctttatacttgattttttcattttagatagttaggcgtaaaggaagcctcctgagggtctggtctgatcctcctgatccttgaagagcttccagcatcattctcccttcatgctccccattttcataagtaactggtggcttgacatgctgggtttggtttgggagccctctgacaaactgaaagggtggatcaggaagcgtctgaccacaccactggtagacacgctctgcgtccaacaagtccttcccagcaacatgtagaaagcaaagtgcatgcttcattctaaggttgttgtctaaatgtttccctgtgtttcctttttgtaggatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcata

SEQ ID NO: 436641 - DNA, 2055 bp, Homo sapiens
  misc_feature (7)..(8): n is a, c, g, or t
  misc_feature (29)..(29): n is a, c, g, or t
gcggtcnnctactactactaaattcgcgnccgcgtcgatggaaaaccggtgaatctgggcttatgggatacagctggacaagaagattatgacagattacgccccctatcctatccgcaaacagttggagaaacgtacggtaaggatataacctcccggggcaaagacaagccgattgccgatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcata

SEQ ID NO: 436642 - DNA, 2640 bp, Homo sapiens
actccagtctgggcaacagagcaagactccgtctcaaaaacgcttgtcttaaggggtggcttcccccagacctacaaagtagcccagaattggaggtcttagtgtcagcaacagtgctgattttgataatgcaagtctgtacattcaaaccagtctcccagaactaggtggaagataggaacatttctgcataggagacttggaatgttctggcagcattaaaaccctgaggcccggctatgttctgggagagccctttggcaggcatcatttacagacgggtccttttcctgtatgctgtggcttcaactaggctgtgtctgagaactcggatggagcacttgaaagtgcccgtggctcccgcctgcctttgcggtaagggacagtgcagaacatctccggctgtgccagctgttgtagattctggtgggtgctgccatgggaggaggagcacgttgttgccccccctcaggatctccctgacctctgtcttcaccatcgttgaacttaacgcctgcttttgaccaggtagcgtggagtgtttcagtggcatttgtcatcgaagatatgttagaatctattgtatgcttttggatctctccggagggttaagacaaaattctaataaagaatcgataagaggttatattgatttattgttgtcctcagtctgtactaaactcaaaccaagttctcatgcattactaggttggagaaacgtacggtaaggatataacctcccggggcaaagacaagccgattgccgatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcata

SEQ ID NO: 436643 - DNA, 2042 bp, Homo sapiens
  misc_feature (67)..(67): n is a, c, g, or t
  misc_feature (81)..(81): n is a, c, g, or t
  misc_feature (87)..(87): n is a, c, g, or t
  misc_feature (108)..(109): n is a, c, g, or t
  misc_feature (116)..(117): n is a, c, g, or t
  misc_feature (119)..(119): n is a, c, g, or t
  misc_feature (129)..(129): n is a, c, g, or t
  misc_feature (131)..(131): n is a, c, g, or t
  misc_feature (134)..(134): n is a, c, g, or t
  misc_feature (145)..(145): n is a, c, g, or t
gaaacagcggttgaaagcctgcgcccttccagccacactcacctactatgcccggcgtggctggcancccatgaaacatcngctagnctctggggggggacagcactnngacctgnngngcagagccangnccnactcaaagatngcccctatcctatccgcaaacagatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcata

SEQ ID NO: 436644 - DNA, 1892 bp, Homo sapiens
  misc_feature (1783)..(1783): n is a, c, g, or t
actccgggagcggcgcgggcgggagcggcgcgggcgggagcggccccgcccggaacctgggagcggcggcgccggcgcgggggaggggaggccggatgtgagtggagcggccatttcctgtttctctgcagttttcctcagctttgggtggtggccgctgccgggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcggcccagcgagcggccctgatgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaaaacaacaagccgggggagccgctttcgcactcagtggtgccaattttgtgggtcgcggttttaatttttcccattaaaacccatttttgtggcacccaattcagataccattttaaggggtagggtggggtcctaagtgtgtaacgagttcagaacctccaatttcttattataacaatttataggcccttaaaatattggagcaagcgccttctcttataaaagcgccttatattgtttccaaaagcggcggccccccccaatttctttgggtcccaggattctacagagagttttggccagaaaatatagcacttttcgtgagagacttaccaccgtggcagatttggcgtggtgcgccgcgaaagaaaaaaccgcgcgagagacccattgggggaaatctttggggcagcagagaaccctctttggcgctctttttgagcaagaaaaggacacgcgggggaaacgtccttcttggggcgagattaaggggaaggggttggcgaggacacccactcctagggtgtgtacctccccctatttaggtaagagtttatctccgccaaataatggtgttagaaagaggcagagaaaagagcagacttcccccgcggaaaaggtgaaaagagagcgtttggcccacctgttgtgagaaatctcaccacccaagtgtgagagttttgaagcacgagcaacactgtgttgttttccccgcgacatattaaacacatttggggtcacgcgtggtcaagcgtgagcaagtgtgcaagcgcgtatagcacagagncatcagagacacatatcttgggggggcaactcagcaaggtccatgacgggcgggaaatataccaccagtaaaggcgaaagttattttgtcgtcgagcaccacgaaggat

SEQ ID NO: 436645 - DNA, 2025 bp, Homo sapiens
gatatcgcacaacactgatcctgctagatactctgaaagcacctccgcgacccgacaacagatgaagggggaagatgcccagccacaggagatggcgtccacaagcttcccaagggccagtggtcccagtcctgaattcagacagcacggggactctgacgggaagagagggagcccacagaatctgcccatagaacatcattttgcttgtaaagagtgttggggataacatcagatgttaccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcata

SEQ ID NO: 436646 - DNA, 1962 bp, Homo sapiens
  misc_feature (42)..(42): n is a, c, g, or t
tttttaagttttattttttatttcataagtcaagatgttgtnggaggagggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagatgtgttcttaatttgcttttcccttgtgagtcctgcatcatttgaaaatgtccgtgcaaaggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcata

SEQ ID NO: 436647 - DNA, 1266 bp, Homo sapiens
  misc_feature (32)..(32): n is a, c, g, or t
  misc_feature (35)..(35): n is a, c, g, or t
ggatggtgttctagaggatcccagcggcgccnttntttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcata

SEQ ID NO: 436648 - DNA, 1127 bp, Homo sapiens
ctgcttagagagagagacagagagagtaggaagttctggagatgggtagcgatatgcttgaccgacaacgtgaatgtacttaatgtcactgaattgcacattcaaaaagggctaaagtggtgaattttacattctgtatattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcata

SEQ ID NO: 436649 - DNA, 779 bp, Homo sapiens
gctggtcctagaggatcccctctatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcata

SEQ ID NO: 436650 - DNA, 524 bp, Homo sapiens
atcgatgccacaaaaataaacatttctcaccacagttgaagttcctgtgattggaaaaatgtactccacactgaaaaagttttgtatatttatgagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcata

SEQ ID NO: 436651 - DNA, 910 bp, Homo sapiens
actccgggagcggcgcgggcgggagcggcgcgggcgggagcggccccgcccggaacctgggagcggcggcgccggcgcgggggaggggaggccggatgtgagtggagcggccatttcctgtttctctgcagttttcctcagctttgggtggtggccgctgccgggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcggcccagcgagcggccctgatgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattgttgctgtaaaatacctgtagtgctcgtcgctcacacagcaaagaccttttggggtctttgctcttttgtgtctttgctggtcatagatcattcatgtcagacctcaccaaattatacattttacataaatatttaa

SEQ ID NO: 436652 - DNA, 497 bp, Homo sapiens
  misc_feature (145)..(145): n is a, c, g, or t
aaggatttattaagtcatacatgcaaaacataatgctaattgcattagcaaaagatcaatgtaaaaacactccacaattctgcaactgtcaatttaaaaaattctgttgtagtggctgaagggtcccacgctgtattctcgccangtgagttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcata

SEQ ID NO: 436653 - DNA, 381 bp, Homo sapiens
tgtgcaggtggcatccctgaggattcagagcttcagtggacgtgagtgctccagctgcataactcactgaagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcata

SEQ ID NO: 436654 - DNA, 595 bp, Homo sapiens
atttctgacggtgatttgtttcacttaaatagcttgttgtttgtttctttcatttctcttaagttttgggttgggtttggtttgtttcccgcaagttttgcccgtgccgccttcctccttgtgcctgcagggacatttgctggtgtggcagcctccaggcccgtccccagcctttttcttggcacaccttctctaggatggctgggacagtgacttagcttctacacctgtgactaaccattttcattccattctacagctttgacaattattctgccaatgttatggtagatggaaaaccggtgaatctgggcttatgggatacagctggacaagaagattatgacagattacgccccctatcctatccgcaaacagtaaggattgcagctgacttttaatgtgtcttttagagtatataattctcgagcgcttaattagtgcatgttacctatggacttgcttatattgccatcatttgggtattgagtaaatagcaaacagggtgggattggttccatgtaaacatccccctagatgcaagcccaggggttttgtgttttgagcgttaccagctgttccattgtcgagcact

SEQ ID NO: 436655 - DNA, 410 bp, Homo sapiens
ggtctggtctgatcctcctgatccttgaagagcttccagcatcattctcccttcatgctccccattttcataagtaactggtggcttgacatgctgggtttggtttgggagccctctgacaaactgaaagggtggatcaggaagcgtctgaccacaccactggtagacacgctctgcgtccaacaagtccttcccagcaacatgtagaaagcaaagtgcatgcttcattctaaggttgttgtctaaatgtttccctgtgtttcctttttgtaggatgtgttcttaatttgcttttcccttgtgagtcctgcatcatttgaaaatgtccgtgcaaaggtaggtggggatttaaaatgtgtatgtaagttatagaatgatcctctcagaaataaatactttaaaatatcact

SEQ ID NO: 436656 - DNA, 2426 bp, Homo sapiens
actccgggagcggcgcgggcgggagcggcgcgggcgggagcggccccgcccggaacctgggagcggcggcgccggcgcgggggaggggaggccggatgtgagtggagcggccatttcctgtttctctgcagttttcctcagctttgggtggtggccgctgccgggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcggcccagcgagcggccctgatgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcata

SEQ ID NO: 436657 - DNA, 2936 bp, Homo sapiens
actccgggagcggcgcgggcgggagcggcgcgggcgggagcggccccgcccggaacctgggagcggcggcgccggcgcgggggaggggaggccggatgtgagtggagcggccatttcctgtttctctgcagttttcctcagctttgggtggtggccgctgccgggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcggcccagcgagcggccctgatgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcataaaaaaaaaaaaaaaaaaaaaaaaaaaaaaaaaaaaaaaaaaaaaaaaaaaaaaaaaaaaaaaagaaaaaaaaaaaaaaaagaaaaaaaaaaaaaacaaaaagaaaaaagaaaaaaagaaaaaaagaaaaaagaaaagaacgaaaacagagagggggggcggtaaactaataaaccacgaggagggcacgaaactcacgacagcacctagaacgaaaacgatcaccatatcaaggcagagacaaaacacagaagacagacacgggcagaacaaaacacaacaaagacggctcgggaaacaaaacacacaactggagacgaaagtcaggaaagaagaaacacactcaataagtggaggggaaacacgaagaagacagaacccctacaaaagaacagaaacgtacaacgagcacaaaaaaacaacagtgtgaagtgaaagggaagaccacaagaagaaacagggcgcgaagcgaaaacagcaagacggacaagaaggaaaccaaaaagagagg

SEQ ID NO: 436658 - DNA, 2748 bp, Homo sapiens
actccgggagcggcgcgggcgggagcggcgcgggcgggagcggccccgcccggaacctgggagcggcggcgccggcgcgggggaggggaggccggatgtgagtggagcggccatttcctgtttctctgcagttttcctcagctttgggtggtggccgctgccgggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcggcccagcgagcggccctgatgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcatagacccacaagggtcctgagaggatcataagagcttagagactcaggccttacctcgtgcacataacctagagtgtggagtcttgtacattgcccatcgtcaataaaaactgccacaggtttacccctttgaaaaacaaaaaacaacgaaagcactcattaatcagagcaagaaaacaacaagcactagcaaggacacagcgatacacgacgagtatagacaaatcaaagttcgagtcaagatgatccagctcaagaacaagagaggggatacccagacgatcaaatataggcgactcgaaacagagagaagcagagaagaat

SEQ ID NO: 436659 - DNA, 2787 bp, Homo sapiens
  misc_feature (2666)..(2666): n is a, c, g, or t
  misc_feature (2759)..(2759): n is a, c, g, or t
  misc_feature (2780)..(2780): n is a, c, g, or t
actccgggagcggcgcgggcgggagcggcgcgggcgggagcggccccgcccggaacctgggagcggcggcgccggcgcgggggaggggaggccggatgtgagtggagcggccatttcctgtttctctgcagttttcctcagctttgggtggtggccgctgccgggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcggcccagcgagcggccctgatgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgcattagcaaaagatcaatgtaaaaacactcccaacattccgggacagggagatcatgtttcacgtttccacaaagctgccatttaccgacggagacgcccagcagctccagagaaagagacacattggaaatgacatcgtggccatcatcttccaagaggaaaacacgccgtttgtcccagacatgatagcctccaatttcttacatgcctacatcgtcgtgcaggtcgagaccccaggcacagagaccccatcctacaaggtaaggagaacgccttgttggagggagtggtgggcctcgacacctcaccctgtgtggatgctgtgatatcagaggncactagtctcagcagtcagagatttccatgagtttgcaggtttctggggttggagctagattctggtagggagaccttcaaggccactgatcncttgctgctcggtcatggatntacttga

SEQ ID NO: 436660 - DNA, 2161 bp, Homo sapiens
actccgggagcggcgcgggcgggagcggcgcgggcgggagcggccccgcccggaacctgggagcggcggcgccggcgcgggggaggggaggccggatgtgagtggagcggccatttcctgtttctctgcagttttcctcagctttgggtggtggccgctgccgggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcggcccagcgagcggccctgatgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccattgcatccagaggacacttgcatccgaggggatcctctgaatcac

SEQ ID NO: 436661 - DNA, 2122 bp, Homo sapiens
  misc_feature (42)..(42): n is a, c, g, or t
tttttaagttttattttttatttcataagtcaagatgttgtnggaggagggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcata

SEQ ID NO: 436662 - DNA, 2483 bp, Homo sapiens
actccgggagcggcgcgggcgggagcggcgcgggcgggagcggccccgcccggaacctgggagcggcggcgccggcgcgggggaggggaggccggatgtgagtggagcggccatttcctgtttctctgcagttttcctcagctttgggtggtggccgctgccgggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcggcccagcgagcggccctgatgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagttggagaaacgtacggtaaggatataacctcccggggcaaagacaagccgattgccgatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcata

SEQ ID NO: 436663 - DNA, 1996 bp, Homo sapiens
cgtgtggtctgttggcgtgtggtctgtgctggtactgtgctccgtgtggtcttgtggcggcgtgtggtcctgtggacaagaagattatgacagattacgccccctatcctatccgcaaacagatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcata

SEQ ID NO: 436664 - DNA, 2249 bp, Homo sapiens
ttctgggattatagacgtgagccaccacgcccggcctctgccaatttttatatgtgatttgatcatctcagaggggcccaacacagctgcagattagctgtttgcagccactttattgtaagtcttaacatggtgtccttctgtgaaccacagtgattcttctcattcactcaccaggataggataccccattatgtgcctttgacaattattctgccaatgttatggtagatggaaaaccggtgaatctgggcttatgggatacagctggacaagaagattatgacagattacgccccctatcctatccgcaaacagttggagaaacgtacggtaaggatataacctcccggggcaaagacaagccgattgccgatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcata

SEQ ID NO: 436665 - DNA, 2714 bp, Homo sapiens
actccgggagcggcgcgggcgggagcggcgcgggcgggagcggccccgcccggaacctgggagcggcggcgccggcgcgggggaggggaggccggatgtgagtggagcggccatttcctgtttctctgcagttttcctcagctttgggtggtggccgctgccgggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcggcccagcgagcggccctgatgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtatggaatcctgtgtttttcctcctccttgtacctcttttattgtagtgacagagactggagtccagtctgggaaaggagggtgtgtgtctcccactcagggcctggtgtactcttggggaaccagctggcaaggccctgtgggtcttaacgtcagcgttggaaggtggaagcagggctgggagccggcagaaggcgcccgggccccaggagctgcctcccgctggtggtgtgatcagaagagagtggggtcgagtgtacattgccgtgtggtcgtgtttcctgtaggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcata

SEQ ID NO: 436666 - DNA, 1727 bp, Homo sapiens
gcggccgcctactactactactactgctcgaattcaagcttctaacgatgtacggggacatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcata

SEQ ID NO: 436667 - DNA, 778 bp, Homo sapiens
actccgggagcggcgcgggcgggagcggcgcgggcgggagcggccccgcccggaacctgggagcggcggcgccggcgcgggggaggggaggccggatgtgagtggagcggccatttcctgtttctctgcagttttcctcagctttgggtggtggccgctgccgggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcggcccagcgagcggccctgatgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagtaaggattgcagctgacttttaatgtgtcttttagagtatataattctcgagcgcttaattagtgcatgttacctatggacttgcttatattgccatcatttgggtattgagtaaatagcaaacagggtgggattggttccatgtaaacatccccctagatgcaagcccaggggttttgtgttttgagcgttaccagctgttccattgtcgagcactttacagtct

SEQ ID NO: 436668 - DNA, 1401 bp, Homo sapiens
aacccagttggcggaggttgcagtgacccaagatcacaccactgcactccatcctgggtgacagagcgagactctatctgaaaaaataaataaaataaaatttaaaaatataaaaagcaccattgcattttaggaaagctatcatatgttgtgtatttcatagagcattttcacttaaacatttgtgaaaagcaccaagttttctctactgctaagagttgtttaacatcaactaatagtgacttctttattgtttctaatgttgtacggaacaggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttaaatgttagagctgttcccggagacttattgcagaaatagatgagaagcaaatcaagactactattcaaaaatgtacttagttttcatttttgtaattataaataatattatttctaatgtcaagtctcctattaaatagaaaatactgggtaattttttagacattcgtgggggaggtttaattctgaactgaagtataatatgtgtaatataagcattttgatcaaggttaatgttacctttacagtagtgtagtgaatgctacttttctctttctgcacattttatttaatgaattaaagacataaaccttttctctcaccagcaaataccaaacagctatcatatgatgaggttgtaaatcagtctagtccaagcaactgtactgtatactgtggaggtgttacttctgggctaacaggtatgggagccttccctgtgtggcattaatttttaaagtgcaaagcttaatatttgtaggatttttatataacttagtgtgatttgtttgttttggttttttgtctaacagaacaactaatgcgtcagactttttcaccatttggacaaataatggaaattcgagtctttccagataaaggatattcatttgttcggtagggatggttttttaaaaaaacatttttcttggtaatgtaactggaaaaccagaaaataaataaaaataaaaaactttttcctccaaaatattttttgaacatttacctcgttttcttaaaaatttaccttggttataaaaaagttgaaattttggccgggtgcggtggctcacgcctgtattcccagcactttgggaggccgagacgggtggatcaccgtcatgagtttgagaccagcctggccaacattgtgaaaccccgtctctactaaaaatacaaaaatataaaaattagccggcatggcggtgcatgcctgtaatcacagctactcgggag

SEQ ID NO: 436669 - DNA, 4615 bp, Homo sapiens
aggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcaatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataaacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 436670 - DNA, 4648 bp, Homo sapiens
aggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaagatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataaacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 436671 - DNA, 5145 bp, Homo sapiens
aggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaagatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttaaatgttagagctgttcccggagacttattgcagaaatagatgagaagcaaatcaagactactattcaaaaatgtacttagttttcatttttgtaattataaataatattatttctaatgtcaagtctcctattaaatagaaaatactgggtaattttttagacattcgtgggggaggtttaattctgaactgaagtataatatgtgtaatataagcattttgatcaaggttaatgttacctttacagtagtgtagtgaatgctacttttctctttctgcacattttatttaatgaattaaagacataaaccttttctctcaccagcaaataccaaacagctatcatatgatgaggttgtaaatcagtctagtccaagcaactgtactgtatactgtggaggtgttacttctgggctaacaggtatgggagccttccctgtgtggcattaatttttaaagtgcaaagcttaatatttgtaggatttttatataacttagtgtgatttgtttgttttggttttttgtctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataaacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 436672 - DNA, 5363 bp, Homo sapiens
aggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatttgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaagatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataaacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 436673 - DNA, 4951 bp, Homo sapiens
gagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataaacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 436674 - DNA, 4441 bp, Homo sapiens
tttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataaacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 436675 - DNA, 4889 bp, Homo sapiens
gagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatggtaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataaacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 436676 - DNA, 4897 bp, Homo sapiens
gagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaatttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataaacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 436677 - DNA, 4253 bp, Homo sapiens
gagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataaacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 436678 - DNA, 4386 bp, Homo sapiens
gagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttaaatgttagagctgttcccggagacttattgcagaaatagatgagaagcaaatcaagactactattcaaaaatcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataaacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 436679 - DNA, 4624 bp, Homo sapiens
aacccagttggcggaggttgcagtgacccaagatcacaccactgcactccatcctgggtgacagagcgagactctatctgaaaaaataaataaaataaaatttaaaaatataaaaagcaccattgcattttaggaaagctatcatatgttgtgtatttcatagagcattttcacttaaacatttgtgaaaagcaccaagttttctctactgctaagagttgtttaacatcaactaatagtgacttctttattgtttctaatgttgtacggaacaggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttaaatgttagagctgttcccggagacttattgcagaaatagatgagaagcaaatcaagactactattcaaaaatgtacttagttttcatttttgtaattataaataatattatttctaatgtcaagtctcctattaaatagaaaatactgggtaattttttagacattcgtgggggaggtttaattctgaactgaagtataatatgtgtaatataagcattttgatcaaggttaatgttacctttacagtagtgtagtgaatgctacttttctctttctgcacattttatttaatgaattaaagacataaaccttttctctcaccagcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataaacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 436680 - DNA, 3813 bp, Homo sapiens
  misc_feature (3670)..(3670): n is a, c, g, or t
  misc_feature (3672)..(3672): n is a, c, g, or t
  misc_feature (3674)..(3674): n is a, c, g, or t
  misc_feature (3678)..(3678): n is a, c, g, or t
  misc_feature (3682)..(3682): n is a, c, g, or t
  misc_feature (3684)..(3684): n is a, c, g, or t
  misc_feature (3689)..(3689): n is a, c, g, or t
aggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcaatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatacgntnanatcnggangnaatangtttaaaggtgctttctggaattggaattagattacttggggtcggaacaccgagggtacctatgggggatcagattacgaaggggataaggctgtgtttgaaacaaaaaaaaagggggtggaa

SEQ ID NO: 436681 - DNA, 2993 bp, Homo sapiens
tggatcccccgggctgcaggttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataaacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 436682 - DNA, 3007 bp, Homo sapiens
gttcctactggtaaacccctccagtatctttgacaccaacccgattaaagtctggcccggcgagtaacacatagacctttattaggattaccggagtaattctttatccatcaaaccagatcaatagctgctttagtctgaaggtgggtcatcaaaagagaccgttgcctctcccttcagcttgccagtttccctgtctgtgtacaaattaatcatgggctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataaacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 436683 - DNA, 2294 bp, Homo sapiens
gcggccgcttactactactactactactactaaattcgcggccgcgtcgactgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataaacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 436684 - DNA, 1250 bp, Homo sapiens
gcggccgcctactactactaaattctcggccgctcgatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataaacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 436685 - DNA, 1811 bp, Homo sapiens
aggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaagatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttaaatgttagagctgttcccggagacttattgcagaaatagatgagaagcaaatcaagactactattcaaaaatgtacttagttttcatttttgtaattataaataatattatttctaatgtcaagtctcctattaaatagaaaatactgggtaattttttagacattcgtgggggaggtttaattctgaactgaagtataatatgtgtaatataagcattttgatcaaggttaatgttacctttacagtagtgtagtgaatgctacttttctctttctgcacattttatttaatgaattaaagacataaaccttttctctcaccagcaaataccaaacagctatcatatgatgaggttgtaaatcagtctagtccaagcaactgtactgtatactgtggaggtgttacttctgggctaacaggtatgggagccttccctgtgtggcattaatttttaaagtgcaaagcttaatatttgtaggatttttatataacttagtgtgatttgtttgttttggttttttgtctaacagaacaactaatgcgtcagactttttcaccatttggacaaataatggaaattcgagtctttccagataaaggatattcatttgttcggtagggatggttttttaaaaaaacatttttcttggtaatgtaactggaaaaccagaaaataaataaaaataaaaaactttttcctccaaaatattttttgaacatttacctcgttttcttaaaaatttaccttggttataaaaaagttgaaattttggccgggtgcggtggctcacgcctgtattcccagcactttgggaggccgagacgggtggatcaccgtcatgagtttgagaccagcctggccaacattgtgaaaccccgtctctactaaaaatacaaaaatataaaaattagccggcatggcggtgcatgcctgtaatcacagctactcgggag

SEQ ID NO: 436686 - DNA, 1395 bp, Homo sapiens
aggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatttgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactg

SEQ ID NO: 436687 - DNA, 1122 bp, Homo sapiens
gagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggtgagctcagtgagaagtgcatggataatgcttaaagagtaaagaatggaaacactccgttttaattactaatctttttttcgtctgctgtttattttactgatgattaaaataaaccctcactagaagatttc

SEQ ID NO: 436688 - DNA, 938 bp, Homo sapiens
aggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaagtcttagttcacttgcacatggattcacataaactgaatggtgtaatgtctgggcaaccaaaactgttggcttttgagaaaactgtcaaatactttaacatcaaactgttgcaatgcaagatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggtgagctcagtgagaagtgcatggataatgcttaaagagtaaagaatggaaacactccgttttaattactaatctttttttcgtctgctgtttattttactgatgattaaaataaaccctcactagaagatttc

SEQ ID NO: 436689 - DNA, 532 bp, Homo sapiens
  misc_feature (488)..(488): n is a, c, g, or t
  misc_feature (492)..(492): n is a, c, g, or t
aggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcaatcatttccatgtctttgttggtgatctcagcccagaaattacaactgaagatataaaagctgcttttgcaccatttggaagaatatcagatgcccnagtngtaaaagacatggcagggttggattggctttgctcctttt

SEQ ID NO: 436690 - DNA, 4669 bp, Homo sapiens
aggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcaatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataaacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaaaaaaaaaacacaaaaaaaacatttgtggggcgccggcccgaaaagttttaaacc

SEQ ID NO: 436691 - DNA, 5034 bp, Homo sapiens
aggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaagatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttaaatgttagagctgttcccggagacttattgcagaaatagatgagaagcaaatcaagactactattcaaaaatgtacttagttttcatttttgtaattataaataatattatttctaatgtcaagtctcctattaaatagaaaatactgggtaattttttagacattcgtgggggaggtttaattctgaactgaagtataatatgtgtaatataagcattttgatcaaggttaatgttacctttacagtagtgtagtgaatgctacttttctctttctgcacattttatttaatgaattaaagacataaaccttttctctcaccagcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataaacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 436692 - DNA, 4767 bp, Homo sapiens
aggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaagtcttagttcacttgcacatggattcacataaactgaatggtgtaatgtctgggcaaccaaaactgttggcttttgagaaaactgtcaaatactttaacatcaaactgttgcaatgcaagatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataaacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 436693 - DNA, 4781 bp, Homo sapiens
aggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaagatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttaaatgttagagctgttcccggagacttattgcagaaatagatgagaagcaaatcaagactactattcaaaaatcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataaacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 436694 - DNA, 4107 bp, Homo sapiens
tagaggactgatatcgtgtgcacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataaacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 436695 - DNA, 4238 bp, Homo sapiens
aacccagttggcggaggttgcagtgacccaagatcacaccactgcactccatcctgggtgacagagcgagactctatctgaaaaaataaataaaataaaatttaaaaatataaaaagcaccattgcattttaggaaagctatcatatgttgtgtatttcatagagcattttcacttaaacatttgtgaaaagcaccaagttttctctactgctaagagttgtttaacatcaactaatagtgacttctttattgtttctaatgttgtacggaacaggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataaacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 436696 - DNA, 4757 bp, Homo sapiens
aggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaagatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagttccagaatggtgtttcatggattgcagtggtgacatgatgaatgtgaccgcctcaattgactcatgctcacacagtggattttaaaatgctccgagaaacctaaaaggcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataaacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 436697 - DNA, 4976 bp, Homo sapiens
aggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaagatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttaaatgttagagctgttcccggagacttattgcagaaatagatgagaagcaaatcaagactactattcaaaaatgtacttagttttcatttttgtaattataaataatattatttctaatgtcaagtctcctattaaatagaaaatactgggtaattttttagacattcgtgggggaggtttaattctgaactgaagtataatatgtgtaatataagcattttgatcaaggttaatgttacctttacagtagtgtagtgaatgctacttttctctttctgcacattttatttaatgaattaaagacataaaccttttctctcaccagcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataaacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 436698 - DNA, 1447 bp, Homo sapiens
aggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaagatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttaaatgttagagctgttcccggagacttattgcagaaatagatgagaagcaaatcaagactactattcaaaaatcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggtagggatggttttttaaaaaaacatttttcttggtaatgtaactggaaaaccagaaaataaataaaaataaaaaactttttcctccaaaatattttttgaacatttacctcgttttcttaaaaatttaccttggttataaaaaagttgaaattttggccgggtgcggtggctcacgcctgtattcccagcactttgggaggccgagacgggtggatcaccgtcatgagtttgagaccagcctggccaacattgtgaaaccccgtctctactaaaaatacaaaaatataaaaattagccggcatggcggtgcatgcctgtaatcacagctactcgggag

SEQ ID NO: 436699 - DNA, 786 bp, Homo sapiens
aggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcaatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggtgagctcagtgagaagtgcatggataatgcttaaagagtaaagaatggaaacactccgttttaattactaatctttttttcgtctgctgtttattttactgatgattaaaataaaccctcactagaagatttc

SEQ ID NO: 436700 - DNA, 611 bp, Homo sapiens
tcactggggctagcagagggctgtgaagctctctctgacttgataaaatccctcctcctaggcttttcagtgcttggctctccctgtgtgggtgtaattggaactgggagaggaaaggattatggaaagcaatagtctgctttctgctagtttccagcagctgttttgggctggtgggggctggggtgttatgtgtgtggtggtgaatttgagtggccgccatttgtggaaatgtgacaacatgtcatcaactgataggtagctagacctgaggaatgtgaggccagaagattctagctgcaaagggccccagctctgcagccccagatgcagggtcagacctctgctctactgctcctagcccctgctgtgacctcgggcaatgcacctgggtggggtaggatgtgtaagtccactctgtcattagcacagtcttccaggaaagaatcctgtgagacagaagaatccggtgagactgagagacacaagaaggagaagttgtgtagcacttatacttacctaccacaccagccagtggataaaggcgctgttctcagggttgctgtagagctagacaggagttagttcatgacagaatcacattgcaaaga

SEQ ID NO: 436701 - DNA, 1573 bp, Homo sapiens
aagaaaagggaacgaggaaggccggtgattggtgaagctctaacggctgttttgactggcgtagccggagccggcgacgtgaggcgggcgttgctcgcgcgacaagtagttgctgggacagcgaaatggaggggtgtgtgtctaacctaatggtctgcaacctggcctacagcgggaagctggaagagttgaaggagagtattctggccgataaatccctggctactagaactgaccaggacagcagaactgcattgcactgggcatgctcagctggacatacagaaattgttgaatttttgttgcaacttggagtgccagtgaatgataaagacgatgcaggttggtctcctcttcatattgcggcttctgctggccgggatgagattgtaaaagcccttctgggaaaaggtgctcaagtgaatgctgtcaatcaaaatggctgtactcccttacattatgcagcttcgaaaaacaggcatgagatcgctgtcatgttactggaaggcggggctaatccagatgctaaggaccattatgaggctacagcaatgcaccgggcagcagccaagggtaacttgaagatgattcatatccttctgtactacaaagcatccacaaacatccaagacactgagggtaacactcctctacacttagcctgtgatgaggagagagtggaagaagcaaaactgctggtgtcccaaggagcaagtatttacattgagaataaagaagaaaagacacccctgcaagtggccaaaggtggcctgggtttaatactcaagagaatggtggaaggttaaacagcttggatttattcttactttgtatgttgtgttgttgtccccagtgtcctacaaactaatgtatttgtgcacaagacatcatctatgaatgatgaagttttctcaccttcaaagtcttataaacatgttgactcttgttcctgctgagttacttgttcgaagcttacagcttgttttccaggcatcgaataactgttgagattgttctactgttgtcgtatattcttctatattgaattctggttaatttggagtaactaattctgtggctgttgtgagtcttcagcaccctcccatgtaccttatatccctctctgaaacagaacagctccaatagcaacaagctagttgttctgccagatgtttctatgtggattctgtaatgttcctccatacagttaaaacatcctaacttgtttttcaagctcactcaggcctacgccaaacgtttctgttttttttaaccatgaggtttaatttatttttgtgataggagggatatttacatattttagtggaccacattttaagttggatggtgtgctctaaaatactgaaaaacaatagcccatatacctatgtatttgtttttgatgggttgtttactctgaaataaaatgtatggttttcttaaaaggaagttttaaagtacctattttgtgtcatcctgtattgaaaagaatgtcaagcttgttaaaatgacatgtaacaaaaatgtattttgatttgtatttcagaaactaaaaaataaaatgttgaaagaa

SEQ ID NO: 436702 - DNA, 610 bp, Homo sapiens
aagaaaagggaacgaggaaggccggtgattggtgaagctctaacggctgttttgactggcgtagccggagccggcgacgtgaggcgggcgttgctcgcgcgacaagtagttgctgggacagcgaaatggaggggtgtgtgtctaacctaatggtctgcaacctggcctacagcgggaagctggaagagttgaaggagagtattctggccgataaatccctggctactagaactgaccaggacagcagaactgcattgcactgggcatgctcagctggacatacagaaattgttgaatttttgttgcaacttggagtgccagtgaatgataaagacgatgtgagtactttgataaagttgagttgataaattcccagttatctttgtactccagactggtgtttactgaagcctgtgcattaagcttataaagaaaattgtaacctttatgactggaaagttacatcatggcccttgtgatcaagcatgagactcatggttgcattattttacaatgttatgtttgccactcatactctgtgatttaaggtaaacatacaggagaggctgaggtaggaggattgctccagcctagtagtttgaggctgcag

SEQ ID NO: 436703 - DNA, 1363 bp, Homo sapiens
aagaaaagggaacgaggaaggccggtgattggtgaagctctaacggctgttttgactggcgtagccggagccggcgacgtgaggcgggcgttgctcgcgcgacaagtagttgctgggacagcgaaatggaggggtgtgtgtctaacctaatggtctgcaacctggcctacagcgggaagctggaagagttgaaggagagtattctggccgataaatccctggctactagaactgaccaggacagcagaactgcattgcactgggcatgctcagctggacatacagaaattgttgaatttttgttgcaacttggagtgccagtgaatgataaagacgatgcaggttggtctcctcttcatattgcggcttctgctggccgggatgagattgtaaaagcccttctgggaaaaggtgctcaagtgaatgctgtcaatcaaaatggctgtactcccttacattatgcagcttcgaaaaacaggcatgagatcgctgtcatgttactggaaggcggggctaatccagatgctaaggaccattatgaggctacagcaatgcaccgggcagcagccaagggtaacttgaagatgattcatatccttctgtactacaaagcatccacaaacatccaagacactgagggtaacactcctctacacttagcctgtgatgaggagagagtggaagaagcaaaactgctggtgtcccaaggagcaagtatttacattgagaataaagaagaaaagacacccctgcaagtggccaaaggtggcctgggtttaatactcaagagaatggtggaaggttaaacagcttggatttattcttactttgtatgttgtgttgttgtccccagtgtcctacaaactaatgtatttgtgcacaagacatcatctatgaatgatgaagttttctcaccttcaaagtcttataaacatgttgactcttgttcctgctgagttacttgttcgaagcttacagcttgttttccaggcatcgaataactgttgagattgttctactgttgtcgtatattcttctatattgaattctggttaatttggagtaactaattctgtggctgttgtgagtcttcagcaccctcccatgtaccttatatccctctctgaaacagaacagctccaatagcaacaagctagttgttctgccagatgtttctatgtggattctgtaatgttcctccatacagttaaaacatcctaacttgtttttcaagctcactcaggcctacgccaaacgtttctgttttttttaaccatgaggtttaatttatttttgtgataggaggttattggcatatgccaataacctccccccttagtcttccaggtagctggaactacag

SEQ ID NO: 436704 - DNA, 1519 bp, Homo sapiens
aagaaaagggaacgaggaaggccggtgattggtgaagctctaacggctgttttgactggcgtagccggagccggcgacgtgaggcgggcgttgctcgcgcgacaagtagttgctgggacagcgaaatggaggggtgtgtgtctaacctaatggtctgcaacctggcctacagcgggaagctggaagagttgaaggagagtattctggccgataaatccctggctactagaactgaccaggacagcagaactgcattgcactgggcatgctcagctggacatacagaaattgttgaatttttgttgcaacttggagtgccagtgaatgataaagacgatgcaggttggtctcctcttcatattgcggcttctgctggccgggatgagattgtaaaagcccttctgggaaaaggtgctcaagtgaatgctgtcaatcaaaatggctgtactcccttacattatgcagcttcgaaaaacaggcatgagatcgctgtcatgttactggaaggcggggctaatccagatgctaaggaccattatgaggctacagcaatgcaccgggcagcagccaagggtaacttgaagatgattcatatccttctgtactacaaagcatccacaaacatccaagacactgagggtaacactcctctacacttagcctgtgatgaggagagagtggaagaagcaaaactgctggtgtcccaaggagcaagtatttacattgagaataaagaaatggtggaaggttaaacagcttggatttattcttactttgtatgttgtgttgttgtccccagtgtcctacaaactaatgtatttgtgcacaagacatcatctatgaatgatgaagttttctcaccttcaaagtcttataaacatgttgactcttgttcctgctgagttacttgttcgaagcttacagcttgttttccaggcatcgaataactgttgagattgttctactgttgtcgtatattcttctatattgaattctggttaatttggagtaactaattctgtggctgttgtgagtcttcagcaccctcccatgtaccttatatccctctctgaaacagaacagctccaatagcaacaagctagttgttctgccagatgtttctatgtggattctgtaatgttcctccatacagttaaaacatcctaacttgtttttcaagctcactcaggcctacgccaaacgtttctgttttttttaaccatgaggtttaatttatttttgtgataggagggatatttacatattttagtggaccacattttaagttggatggtgtgctctaaaatactgaaaaacaatagcccatatacctatgtatttgtttttgatgggttgtttactctgaaataaaatgtatggttttcttaaaaggaagttttaaagtacctattttgtgtcatcctgtattgaaaagaatgtcaagcttgttaaaatgacatgtaacaaaaatgtattttgatttgtatttcagaaactaaaaaataaaatgttgaaagaa

SEQ ID NO: 436705 - DNA, 1474 bp, Homo sapiens
aagaaaagggaacgaggaaggccggtgattggtgaagctctaacggctgttttgactggcgtagccggagccggcgacgtgaggcgggcgttgctcgcgcgacaagtagttgctgggacagcgaaatggaggggtgtgtgtctaacctaatggtctgcaacctggcctacagcgggaagctggaagagttgaaggagagtattctggccgataaatccctggctactagaactgaccaggcaggttggtctcctcttcatattgcggcttctgctggccgggatgagattgtaaaagcccttctgggaaaaggtgctcaagtgaatgctgtcaatcaaaatggctgtactcccttacattatgcagcttcgaaaaacaggcatgagatcgctgtcatgttactggaaggcggggctaatccagatgctaaggaccattatgaggctacagcaatgcaccgggcagcagccaagggtaacttgaagatgattcatatccttctgtactacaaagcatccacaaacatccaagacactgagggtaacactcctctacacttagcctgtgatgaggagagagtggaagaagcaaaactgctggtgtcccaaggagcaagtatttacattgagaataaagaagaaaagacacccctgcaagtggccaaaggtggcctgggtttaatactcaagagaatggtggaaggttaaacagcttggatttattcttactttgtatgttgtgttgttgtccccagtgtcctacaaactaatgtatttgtgcacaagacatcatctatgaatgatgaagttttctcaccttcaaagtcttataaacatgttgactcttgttcctgctgagttacttgttcgaagcttacagcttgttttccaggcatcgaataactgttgagattgttctactgttgtcgtatattcttctatattgaattctggttaatttggagtaactaattctgtggctgttgtgagtcttcagcaccctcccatgtaccttatatccctctctgaaacagaacagctccaatagcaacaagctagttgttctgccagatgtttctatgtggattctgtaatgttcctccatacagttaaaacatcctaacttgtttttcaagctcactcaggcctacgccaaacgtttctgttttttttaaccatgaggtttaatttatttttgtgataggagggatatttacatattttagtggaccacattttaagttggatggtgtgctctaaaatactgaaaaacaatagcccatatacctatgtatttgtttttgatgggttgtttactctgaaataaaatgtatggttttcttaaaaggaagttttaaagtacctattttgtgtcatcctgtattgaaaagaatgtcaagcttgttaaaatgacatgtaacaaaaatgtattttgatttgtatttcagaaactaaaaaataaaatgttgaaagaa

SEQ ID NO: 436706 - DNA, 1450 bp, Homo sapiens
aagaaaagggaacgaggaaggccggtgattggtgaagctctaacggctgttttgactggcgtagccggagccggcgacgtgaggcgggcgttgctcgcgcgacaagtagttgctgggacagcgaaatggaggggtgtgtgtctaacctaatggtctgcaacctggcctacagcgggaagctggaagagttgaaggagagtattctggccgataaatccctggctactagaactgaccaggacagcagaactgcattgcactgggcatgctcagctggacatacagaaattgttgaatttttgttgcaacttggagtgccagtgaatgataaagacgatgcagcttcgaaaaacaggcatgagatcgctgtcatgttactggaaggcggggctaatccagatgctaaggaccattatgaggctacagcaatgcaccgggcagcagccaagggtaacttgaagatgattcatatccttctgtactacaaagcatccacaaacatccaagacactgagggtaacactcctctacacttagcctgtgatgaggagagagtggaagaagcaaaactgctggtgtcccaaggagcaagtatttacattgagaataaagaagaaaagacacccctgcaagtggccaaaggtggcctgggtttaatactcaagagaatggtggaaggttaaacagcttggatttattcttactttgtatgttgtgttgttgtccccagtgtcctacaaactaatgtatttgtgcacaagacatcatctatgaatgatgaagttttctcaccttcaaagtcttataaacatgttgactcttgttcctgctgagttacttgttcgaagcttacagcttgttttccaggcatcgaataactgttgagattgttctactgttgtcgtatattcttctatattgaattctggttaatttggagtaactaattctgtggctgttgtgagtcttcagcaccctcccatgtaccttatatccctctctgaaacagaacagctccaatagcaacaagctagttgttctgccagatgtttctatgtggattctgtaatgttcctccatacagttaaaacatcctaacttgtttttcaagctcactcaggcctacgccaaacgtttctgttttttttaaccatgaggtttaatttatttttgtgataggagggatatttacatattttagtggaccacattttaagttggatggtgtgctctaaaatactgaaaaacaatagcccatatacctatgtatttgtttttgatgggttgtttactctgaaataaaatgtatggttttcttaaaaggaagttttaaagtacctattttgtgtcatcctgtattgaaaagaatgtcaagcttgttaaaatgacatgtaacaaaaatgtattttgatttgtatttcagaaactaaaaaataaaatgttgaaagaa

SEQ ID NO: 436707 - DNA, 1491 bp, Homo sapiens
aagaaaagggaacgaggaaggccggtgattggtgaagctctaacggctgttttgactggcgtagccggagccggcgacgtgaggcgggcgttgctcgcgcgacaagtagttgctgggacagcgaaatggaggggtgtgtgtctaacctaatggtctgcaacctggcctacagcgggaagctggaagagttgaaggagagtattctggccgataaatccctggctactagaactgaccaggacagcagaactgcattgcactgggcatgctcagctggacatacagaaattgttgaatttttgttgcaacttggagtgccagtgaatgataaagacgatgcaggttggtctcctcttcatattgcggcttctgctggccgggatgagattgtaaaagcccttctgggaaaaggtgctcaagtgaatgctgtcaatcaaaatggctgtactcccttacattatgcagcttcgaaaaacaggcatgagatcgctgtcatgttactggaaggcggggctaatccagatgctaaggaccattatgaggctacagcaatgcaccgggcagcagccaagggtaacttgaagatgattcatatccttctgtactacaaagcatccacaaacatccaagacactgagggtaacactcctctacacttagcctgtgatgaggagagagtggaagaagcaaaactgctggtgtcccaaggagcaagtatttacattgagaataaagaagaaaagacacccctgcaagtggccaaaggtggcctgggtttaatactcaagagaatggtggaaggttaaacagcttggatttattcttactttgtatgttgtgttgttgtccccagtgtcctacaaactaatgtatttgtgcacaagacatcatctatgaatgatgaagttttctcaccttcaaagtcttataaacatgttgactcttgttcctgctgagttacttgttcgaagcttacagcttgttttccaggcatcgaataactgttgagattgttctactgttgtcgtatattcttctatattgaattctggttaatttggagtaactaattctgtggctgttgtgagtcttcagcaccctcccatgtaatgttcctccatacagttaaaacatcctaacttgtttttcaagctcactcaggcctacgccaaacgtttctgttttttttaaccatgaggtttaatttatttttgtgataggagggatatttacatattttagtggaccacattttaagttggatggtgtgctctaaaatactgaaaaacaatagcccatatacctatgtatttgtttttgatgggttgtttactctgaaataaaatgtatggttttcttaaaaggaagttttaaagtacctattttgtgtcatcctgtattgaaaagaatgtcaagcttgttaaaatgacatgtaacaaaaatgtattttgatttgtatttcagaaactaaaaaataaaatgttgaaagaa

SEQ ID NO: 436708 - DNA, 1494 bp, Homo sapiens
aagaaaagggaacgaggaaggccggtgattggtgaagctctaacggctgttttgactggcgtagccggagccggcgacgtgaggcgggcgttgctcgcgcgacaagtagttgctgggacagcgaaatggaggggtgtgtgtctaacctaatggtctgcaacctggcctacagcgggaagctggaagagttgaaggagagtattctggccgataaatccctggctactagaactgaccaggacagcagaactgcattgcactgggcatgctcagctggacatacagaaattgttgaatttttgttgcaacttggagtgccagtgaatgataaagacgatgcaggttggtctcctcttcatattgcggcttctgctggccgggatgagattgtaaaagcccttctgggaaaaggtgctcaagtgaatgctgtcaatcaaaatggctgtactcccttacattatgcagcttcgaaaaacaggcatgagatcgctgtcatgttactggaaggcggggctaatccagatgctaaggaccattatgaggctacagcaatgcaccgggcagcagccaaggacacttagcctgtgatgaggagagagtggaagaagcaaaactgctggtgtcccaaggagcaagtatttacattgagaataaagaagaaaagacacccctgcaagtggccaaaggtggcctgggtttaatactcaagagaatggtggaaggttaaacagcttggatttattcttactttgtatgttgtgttgttgtccccagtgtcctacaaactaatgtatttgtgcacaagacatcatctatgaatgatgaagttttctcaccttcaaagtcttataaacatgttgactcttgttcctgctgagttacttgttcgaagcttacagcttgttttccaggcatcgaataactgttgagattgttctactgttgtcgtatattcttctatattgaattctggttaatttggagtaactaattctgtggctgttgtgagtcttcagcaccctcccatgtaccttatatccctctctgaaacagaacagctccaatagcaacaagctagttgttctgccagatgtttctatgtggattctgtaatgttcctccatacagttaaaacatcctaacttgtttttcaagctcactcaggcctacgccaaacgtttctgttttttttaaccatgaggtttaatttatttttgtgataggagggatatttacatattttagtggaccacattttaagttggatggtgtgctctaaaatactgaaaaacaatagcccatatacctatgtatttgtttttgatgggttgtttactctgaaataaaatgtatggttttcttaaaaggaagttttaaagtacctattttgtgtcatcctgtattgaaaagaatgtcaagcttgttaaaatgacatgtaacaaaaatgtattttgatttgtatttcagaaactaaaaaataaaatgttgaaagaa

SEQ ID NO: 436709 - DNA, 1634 bp, Homo sapiens
aagaaaagggaacgaggaaggccggtgattggtgaagctctaacggctgttttgactggcgtagccggagccggcgacgtgaggcgggcgttgctcgcgcgacaagtagttgctgggacagcgaaatggaggggtgtgtgtctaacctaatggtctgcaacctggcctacagcgggaagctggaagagttgaaggagagtattctggccgataaatccctggctactagaactgaccaggacagcagaactgcattgcactgggcatgctcagctggacatacagaaattgttgaatttttgttgcaacttggagtgccagtgaatgataaagacgatgcaggttggtctcctcttcatattgcggcttctgctggccgggatgagattgtaaaagcccttctgggaaaaggtgctcaagtgttgggaaaaaaaatttggggggccccccctttttggggggggctcccccccccaaaaaaaaaatgctgtcaatcaaaatggctgtactcccttacattatgcagcttcgaaaaacaggcatgagatcgctgtcatgttactggaaggcggggctaatccagatgctaaggaccattatgaggctacagcaatgcaccgggcagcagccaagggtaacttgaagatgattcatatccttctgtactacaaagcatccacaaacatccaagacactgagggtaacactcctctacacttagcctgtgatgaggagagagtggaagaagcaaaactgctggtgtcccaaggagcaagtatttacattgagaataaagaagaaaagacacccctgcaagtggccaaaggtggcctgggtttaatactcaagagaatggtggaaggttaaacagcttggatttattcttactttgtatgttgtgttgttgtccccagtgtcctacaaactaatgtatttgtgcacaagacatcatctatgaatgatgaagttttctcaccttcaaagtcttataaacatgttgactcttgttcctgctgagttacttgttcgaagcttacagcttgttttccaggcatcgaataactgttgagattgttctactgttgtcgtatattcttctatattgaattctggttaatttggagtaactaattctgtggctgttgtgagtcttcagcaccctcccatgtaccttatatccctctctgaaacagaacagctccaatagcaacaagctagttgttctgccagatgtttctatgtggattctgtaatgttcctccatacagttaaaacatcctaacttgtttttcaagctcactcaggcctacgccaaacgtttctgttttttttaaccatgaggtttaatttatttttgtgataggagggatatttacatattttagtggaccacattttaagttggatggtgtgctctaaaatactgaaaaacaatagcccatatacctatgtatttgtttttgatgggttgtttactctgaaataaaatgtatggttttcttaaaaggaagttttaaagtacctattttgtgtcatcctgtattgaaaagaatgtcaagcttgttaaaatgacatgtaacaaaaatgtattttgatttgtatttcagaaactaaaaaataaaatgttgaaagaa

SEQ ID NO: 436710 - DNA, 2539 bp, Homo sapiens
caaaagtagtttgtctttactaggccaccgtctcgtcagcgttacggagtattttgtccgcctgccgccgccgtcccagatattaatcacggagttccagggagaaggaacttgtgaaatgggggagccggctggggttgccggcaccatggagtcaccttttagcccgggactctttcacaggctggatgaagattgggattctgctctctttgctgaactcggttatttcacagacactgatgagctgcaattggaagcagcaaatgagacgtatgaaaacaattttgataatcttgattttgatttggatttgatgccttgggagtcagacatttgggacatcaacaaccaaatctgtacagttaaagatattaaggcagaaccccagccactttctccagcctcctcaagttattcagtctcgtctcctcggtcagtggactcttattcttcaactcagcatgttcctgaggagttggatttgtcttctagttctcagatgtctcccctttccttatatggtgaaaactctaatagtctctcttcagcggagccactgaaggaagataagcctgtcactggtcctaggaacaagactgaaaatggactgactccaaagaaaaaaattcaggtgaattcaaaaccttcaattcagcccaagcctttattgcttccagcagcacccaagactcaaacaaactccagtgttccagcaaaaaccatcattattcagacagtaccaacgcttatgccattggcaaagcagcaaccaattatcagtttacaacctgcacccactaaaggccagacggttttgctgtctcagcctactgtggtacaacttcaagcacctggagttctgccctctgctcagccagtccttgctgttgctgggggagtcacacagctccctaatcacgtggtgaatgtggtaccagccccttcagcgaatagcccagtgaatggaaaactttccgtgactaaacctgtcctacaaagtaccatgagaaatgtcggttcagatattgctgtgctaaggagacagcaacgtatgataaaaaatcgagaatccgcttgtcagtctcgcaagaagaagaaagaatatatgctagggttagaggcgagattaaaggctgccctctcagaaaacgagcaactgaagaaagaaaatggaacactgaagcggcagctggatgaagttgtgtcagagaaccagaggcttaaagtccctagtccaaagcgaagagttgtctgtgtgatgatagtattggcatttataatactgaactatggacctatgagcatgttggaacaggattccaggagaatgaaccctagtgtgagccctgcaaatcaaaggaggcaccttctaggattttctgctaaagaggcacaggacacatcagatggtattatccagaaaaacagctacagatatgatcattctgtttcaaatgacaaagccctgatggtgctaactgaagaaccattgctttacattcctccacctccttgtcagcccctaattaacacaacagagtctctcaggttaaatcatgaacttcgaggatgggttcatagacatgaagtagaaaggaccaagtcaagaagaatgacaaataatcaacagaaaacccgtattcttcagggtgctctggaacagggctcaaattctcagctgatggctgttcaatacacagaaaccactagtagtatcagcaggaactcagggagtgagctacaagtgtattatgcttcacccagaagttatcaagacttttttgaagccatccgcagaaggggagacacattttatgttgtgtcatttcgaagggatcacctgctgttaccagctaccacccataacaagaccacaagaccaaaaatgtcaattgtgttaccagcaataaacataaatgagaatgtgatcaatgggcaggactacgaagtgatgatgcagattgactgtcaggtgatggacaccaggatcctccatatcaaaagttcgtcggttcctccttacctccgagatcagcagaggaatcaaaccaacaccttctttggctcccctcccgcagccacagaggcaacccacgttgtcagcaccatccctgagtcattacaatagcaccctgcagctatgctggaaaactgagcgtgggaccctgccagactgaagagcaggtgagcaaaatgctgctttctgccttggtggcaggcagagaactgtctcgtactagaattcaaggaggaaagaagaagaaataaaagaagctgctccatttttcatcatctacccatctatttggaaagcactggaattcagatgcaagagaacaatgtttcttcagtggcaaatgtagccctgcatcctccagtgttacctggtgtagatttttttttctgtacctttctaaacctctcttccctctgtgatggttttgtgtttaaacagtcatcttcttttaaataatatccacctctcctttttgccatttcacttattgattcataaagtgaattttatttaaagcta

SEQ ID NO: 436711 - DNA, 2903 bp, Homo sapiens
  misc_feature (2887)..(2887): n is a, c, g, or t
caaaagtagtttgtctttactaggccaccgtctcgtcagcgttacggagtattttgtccgcctgccgccgccgtcccagatattaatcacggagttccagggagaaggaacttgtgaaatgggggagccggctggggttgccggcaccatggagtcaccttttagcccgggactctttcacaggctggatgaagattgggattctgctctctttgctgaactcggttatttcacagacactgatgagctgcaattggaagcagcaaatgagacgtatgaaaacaattttgataatcttgattttgatttggatttgatgccttgggagtcagacatttgggacatcaacaaccaaatctgtacagttaaagatattaaggcagaaccccagccactttctccagcctcctcaagttattcagtctcgtctcctcggtcagtggactcttattcttcaactcagcatgttcctgaggagttggatttgtcttctagttctcagatgtctcccctttccttatatggtgaaaactctaatagtctctcttcagcggagccactgaaggaagataagcctgtcactggtcctaggaacaagactgaaaatggactgactccaaagaaaaaaattcaggtgaattcaaaaccttcaattcagcccaagcctttattgcttccagcagcacccaagactcaaacaaactccagtgttccagcaaaaaccatcattattcagacagtaccaacgcttatgccattggcaaagcagcaaccaattatcagtttacaacctgcacccactaaaggccagacggttttgctgtctcagcctactgtggtacaacttcaagcacctggagttctgccctctgctcagccagtccttgctgttgctgggggagtcacacagctccctaatcacgtggtgaatgtggtaccagccccttcagcgaatagcccagtgaatggaaaactttccgtgactaaacctgtcctacaaagtaccatgagaaatgtcggttcagatattgctgtgctaaggagacagcaacgtatgataaaaaatcgagaatccgcttgtcagtctcgcaagaagaagaaagaatatatgctagggttagaggcgagattaaaggctgccctctcagaaaacgagcaactgaagaaagaaaatggaacactgaagcggcagctggatgaagttgtgtcagagaaccagaggcttaaagtccctagtccaaagcgaagagttgtctgtgtgatgatagtattggcatttataatactgaactatggacctatgagcatgttggaacaggattccaggagaatgaaccctagtgtgagccctgcaaatcaaaggaggcaccttctaggattttctgctaaagaggcacaggacacatcagatggtattatccagaaaaacagctacagatatgatcattctgtttcaaatgacaaagccctgatggtgctaactgaagaaccattgctttacattcctccacctccttgtcagcccctaattaacacaacagagtctctcaggttaaatcatgaacttcgaggatgggttcatagacatgaagtagaaaggaccaagtcaagaagaatgacaaataatcaacagaaaacccgtattcttcagggtgctctggaacagggctcaaattctcagctgatggctgttcaatacacagaaaccactagtagtatcagcaggaactcagggagtgagctacaagtgtattatgcttcacccagaagttatcaagacttttttgaagccatccgcagaaggggagacacattttatgttgtgtcatttcgaagggatcacctgctgttaccagctaccacccataacaagaccacaagaccaaaaatgtcaattgtgttaccagcaataaacataaatgagaatgtgatcaatgggcaggactacgaagtgatgatgcagattgactgtcaggtgatggacaccaggatcctccatatcaaaagttcgtcggttcctccttacctccgagatcagcagaggaatcaaaccaacaccttctttggctcccctcccgcagccacagaggcaacccacgttgtcagcaccatccctgagtcattacaatagcaccctgcagctatgctggaaaactgagcgtgggaccctgccagactgaagagcaggtgagcaaaatgctgctttctgccttggtggcaggcagagaactgtctcgtactagaattcaaggaggaaagaagaagaaataaaagaagctgctccatttttcatcatctacccatctatttggaaagcactggaattcagatgcaagagaacaatgtttcttcagtggcaaatgtagccctgcatcctccagtgttacctggtgtagatttttttttctgtacctttctaaacctctcttccctctgtgatggttttgtgtttaaacagtcatcttcttttaaataatatccacctctcctttttgccatttcacttattgattcataaagtgaattttatttaaagctatgccacacatgcatgttcaaatggtttccactgattcgatttttcattcatttaatgcaaacccattctggatattgtgcttatttgagaaaacacatttcaaaaccagaaaagccaaaaacactccaaaaacaagcaaaacaatttggagctttagataaaaggaaaaactcccagttggtaaagtttatctttacttaggatttgtggctcacacctaaacaaagggggtcagggagtgggtacaaatttgagaaaatagaagggtaagggatggtcttgatctcctgacctcgtgatccgcccgcctcggcctcccaaagtgctgggattacaggcgtgagccancggcccggcgtcgacg

SEQ ID NO: 436712 - DNA, 3034 bp, Homo sapiens
caaaagtagtttgtctttactaggccaccgtctcgtcagcgttacggagtattttgtccgcctgccgccgccgtcccagatattaatcacggagttccagggagaaggaacttgtgaaatgggggagccggctggggttgccggcaccatggagtcaccttttagcccgggactctttcacaggctggatgaagattgggattctgctctctttgctgaactcggttatttcacagacactgatgagctgcaattggaagcagcaaatgagacgtatgaaaacaattttgataatcttgattttgatttggatttgatgccttgggagtcagacatttgggacatcaacaaccaaatctgtacagttaaagatattaaggcagaaccccagccactttctccagcctcctcaagttattcagtctcgtctcctcggtcagtggactcttattcttcaactcagcatgttcctgaggagttggatttgtcttctagttctcagatgtctcccctttccttatatggtgaaaactctaatagtctctcttcagcggagccactgaaggaagataagcctgtcactggtcctaggaacaagactgaaaatggactgactccaaagaaaaaaattcaggtgaattcaaaaccttcaattcagcccaagcctttattgcttccagcagcacccaagactcaaacaaactccagtgttccagcaaaaaccatcattattcagacagtaccaacgcttatgccattggcaaagcagcaaccaattatcagtttacaacctgcacccactaaaggccagacggttttgctgtctcagcctactgtggtacaacttcaagcacctggagttctgccctctgctcagccagtccttgctgttgctgggggagtcacacagctccctaatcacgtggtgaatgtggtaccagccccttcagcgaatagcccagtgaatggaaaactttccgtgactaaacctgtcctacaaagtaccatgagaaatgtcggttcagatattgctgtgctaaggagacagcaacgtatgataaaaaatcgagaatccgcttgtcagtctcgcaagaagaagaaagaatatatgctagggttagaggcgagattaaaggctgccctctcagaaaacgagcaactgaagaaagaaaatggaacactgaagcggcagctggatgaagttgtgtcagagaaccagaggcttaaagtccctagtccaaagcgaagagttgtctgtgtgatgatagtattggcatttataatactgaactatggacctatgagcatgttggaacaggattccaggagaatgaaccctagtgtgagccctgcaaatcaaaggaggcaccttctaggattttctgctaaagaggcacaggacacatcagatggtattatccagaaaaacagctacagatatgatcattctgtttcaaatgacaaagccctgatggtgctaactgaagaaccattgctttacattcctccacctccttgtcagcccctaattaacacaacagagtctctcaggttaaatcatgaacttcgaggatgggttcatagacatgaagtagaaaggaccaagtcaagaagaatgacaaataatcaacagaaaacccgtattcttcagggtgctctggaacagggctcaaattctcagctgatggctgttcaatacacagaaaccactagtagtatcagcaggaactcagggagtgagctacaagtgtattatgcttcacccagaagttatcaagacttttttgaagccatccgcagaaggggagacacattttatgttgtgtcatttcgaagggatcacctgctgttaccagctaccacccataacaagaccacaagaccaaaaatgtcaattgtgttaccagcaataaacataaatgagaatgtgatcaatgggcaggactacgaagtgatgatgcagattgactgtcaggtgatggacaccaggatcctccatatcaaaagttcgtcggttcctccttacctccgagatcagcagaggaatcaaaccaacaccttctttggctcccctcccgcagccacagaggcaacccacgttgtcagcaccatccctgagtcattacaatagcaccctgcagctatgctggaaaactgagcgtgggaccctgccagactgaagagcaggtgagcaaaatgctgctttctgccttggtggcaggcagagaactgtctcgtactagaattcaaggaggaaagaagaagaaataaaagaagctgctccatttttcatcatctacccatctatttggaaagcactggaattcagatgcaagagaacaatgtttcttcagtggcaaatgtagccctgcatcctccagtgttacctggtgtagatttttttttctgtacctttctaaacctctcttccctctgtgatggttttgtgtttaaacagtcatcttcttttaaataatatccacctctcctttttgccatttcacttattgattcataaagtgaattttatttaaagctatgccacacatgcatgttcaaaaaaaaaaaaaaaaaaaaaaaaaaaacaaaaaaagaaaaaaaacaaaaaaagaaccaaaaaaaaaaaaggggggggggggaaaaaaatatgaccaggggagggacccacatcacaagcccccacacatagcgaaaaaagacgcgcccacaaaggagcgcaccaaaaataaaacacagacggacagcgaagataaaaaacccgcgcgagaaaaacacatccactgacaccctggggacgacccccatcggggggagcaacacagcgagacaccccccaccacgagtgaaaagacgcaccgggagagaaaaaaaaacacgaggagcaagaggcgggccaccaccgaccgaatagttccgccgggacgaacctggtccagccggtcataaatagccgcgcgccaagtaacagacacgacacgcccgccaccgagcaccaggcaaggcagagggcaccaggaggcggcgggctcgcagc

SEQ ID NO: 436713 - DNA, 2654 bp, Homo sapiens
caggaagacaagtgtcctgctctgtgtcatctttgggctttataaaccatgttccatctgttgtctcatttgaatctcaggaaaaccttgtgaaatatttgttatttttcatgttttacatgtgaggaattggaggcttagagaagttgaccaagtatcccagacatactcaagtgagcagtctcagagtaacatcttgaacccagatctcctgtctccaaattttgtgctcattccactatttcacattaaaacctgaagatctccctgctcttttcatcttaacgtaatttcagctttttgtgtgtggctctccaagccacagagcagcagcagcttttgaggataagaagcagtttcttttaaggataagaagcagtatggttcttacctgcatgttggaacaggattccaggagaatgaaccctagtgtgagccctgcaaatcaaaggaggcaccttctaggattttctgctaaagaggcacaggacacatcagatggtattatccagaaaaacagctacagatatgatcattctgtttcaaatgacaaagccctgatggtgctaactgaagaaccattgctttacattcctccacctccttgtcagcccctaattaacacaacagagtctctcaggttaaatcatgaacttcgaggatgggttcatagacatgaagtagaaaggaccaagtcaagaagaatgacaaataatcaacagaaaacccgtattcttcagggtgctctggaacagggctcaaattctcagctgatggctgttcaatacacagaaaccactagtagtatcagcaggaactcagggagtgagctacaagtgtattatgcttcacccagaagttatcaagacttttttgaagccatccgcagaaggggagacacattttatgttgtgtcatttcgaagggatcacctgctgttaccagctaccacccataacaagaccacaagaccaaaaatgtcaattgtgttaccagcaataaacataaatgagaatgtgatcaatgggcaggactacgaagtgatgatgcagattgactgtcaggtgatggacaccaggatcctccatatcaaaagttcgtcggttcctccttacctccgagatcagcagaggaatcaaaccaacaccttctttggctcccctcccgcagccacagaggcaacccacgttgtcagcaccatccctgagtcattacaatagcaccctgcagctatgctggaaaactgagcgtgggaccctgccagactgaagagcaggtgagcaaaatgctgctttctgccttggtggcaggcagagaactgtctcgtactagaattcaaggaggaaagaagaagaaataaaagaagctgctccatttttcatcatctacccatctatttggaaagcactggaattcagatgcaagagaacaatgtttcttcagtggcaaatgtagccctgcatcctccagtgttacctggtgtagatttttttttctgtacctttctaaacctctcttccctctgtgatggttttgtgtttaaacagtcatcttcttttaaataatatccacctctcctttttgccatttcacttattgattcataaagtgaattttatttaaagctatgccacacatgcatgttcaaatggtttccactgattcgatttttcattcatttaatgcaaacccattctggatattgtgcttatttgagaaaacacatttcaaaaccagaaaagccaaaaacactccaaaaacaagcaaaacaatttggagctttagataaaaggaaaaactcccagttggtaaagtttatctttacttaggatttgtggctcacacctaaacaaagggggtcagggagtgggtacaaatttgagaaaatagaagggtaagggaagggccagtggtggggtttggagagaggagatagctccattaatacacatgtttaaaagatggaaagttcacgcctgtaatcccagcactttgggaggccgaggcgggcggatcacgaggtcaggagatcaagaccatcccggctaaaacggtgaaaccccgtctctactaaaaatacaaaaaattagccgggcgtagtgacgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagatggaaagttcgatgtgactgcagtatgagattaaagccacaactattgtttattttggggactctaggccaccaagtattagcacacatacttatgttttctctactaatctggtccaggtcctcatggaccacaggacaaagctttcattttcattcattcttctattgaaattataccaaattcagctgaggaatatggaagtaactttagacttaaacaagacaaaagttttttcactgaagaattgacaagtatttgctccttaaaacaatgcagattagtgaacgtggattcctgctgagggagtgcatcccataatatggcaataattttcagtttctccaacgaaaagatagtgaaggaattaaatcttttgtcctcccatggttaaa

SEQ ID NO: 436714 - DNA, 3132 bp, Homo sapiens
caaaagtagtttgtctttactaggccaccgtctcgtcagcgttacggagtattttgtccgcctgccgccgccgtcccagatattaatcacggagttccagggagaaggaacttgtgaaatgggggagccggctggggttgccggcaccatggagtcaccttttagcccgggactctttcacaggctggatgaagattgggattctgctctctttgctgaactcggttatttcacagacactgatgagctgcaattggaagcagcaaatgagacgtatgaaaacaattttgataatcttgattttgatttggatttgatgccttgggagtcagacatttgggacatcaacaaccaaatctgtacagttaaagatattaaggcagaaccccagccactttctccagcctcctcaagttattcagtctcgtctcctcggtcagtggactcttattcttcaactcagcatgttcctgaggagttggatttgtcttctagttctcagatgtctcccctttccttatatggtgaaaactctaatagtctctcttcagcggagccactgaaggaagataagcctgtcactggtcctaggaacaagactgaaaatggactgactccaaagaaaaaaattcaggtgaattcaaaaccttcaattcagcccaagcctttattgcttccagcagcacccaagactcaaacaaactccagtgttccagcaaaaaccatcattattcagacagtaccaacgcttatgccattggcaaagcagcaaccaattatcagtttacaacctgcacccactaaaggccagacggttttgctgtctcagcctactgtggtacaacttcaagcacctggagttctgccctctgctcagccagtccttgctgttgctgggggagtcacacagctccctaatcacgtggtgaatgtggtaccagccccttcagcgaatagcccagtgaatggaaaactttccgtgactaaacctgtcctacaaagtaccatgagaaatgtcggttcagatattgctgtgctaaggagacagcaacgtatgataaaaaatcgagaatccgcttgtcagtctcgcaagaagaagaaagaatatatgctagggttagaggcgagattaaaggctgccctctcagaaaacgagcaactgaagaaagaaaatggaacactgaagcggcagctggatgaagttgtgtcagagaaccagaggcttaaagtccctagtccaaagcgaagagttgtctgtgtgatgatagtattggcatttataatactgaactatggacctatgagcatgttggaacaggattccaggagaatgaaccctagtgtgagccctgcaaatcaaaggaggcaccttctaggattttctgctaaagaggcacaggacacatcagatggtattatccagaaaaacagctacagatatgatcattctgtttcaaatgacaaagccctgatggtgctaactgaagaaccattgctttacattcctccacctccttgtcagcccctaattaacacaacagagtctctcaggttaaatcatgaacttcgaggatgggttcatagacatgaagtagaaaggaccaagtcaagaagaatgacaaataatcaacagaaaacccgtattcttcagggtgctctggaacagggctcaaattctcagctgatggctgttcaatacacagaaaccactagtagtatcagcaggaactcagggagtgagctacaagtgtattatgcttcacccagaagttatcaagacttttttgaagccatccgcagaaggggagacacattttatgttgtgtcatttcgaaggtagagacggggttcaccatgttggccagtctggtctcgagctcctggcctcaactgatccgcctgccttggcctcctaaagtgctgggattacaggcttgagccactgcactcggcctgaagcattttatgatgctcactaccaagtgttcataagcggtaaataaagcccttgggctaggtaatgtaagatccattgcaacctggagatgaagaactttgtaaaggggataattgttatcacccatcagagcatcagagttttaagatgatctagatttagtcccactaattatatttctcctaacttttatagacagagaaatcagtgaaaaatatgtatttctaaggattaaatcccaatccatagctcaaggctacctttatgtctaatagttgtgatataatatgttgcttagaataggttctataaatggaattcacacataggaccccagaatcgcttcttcacagggtttcagagttggaggacatataaaaggataaatcaatccataaatctctaagtattcctaaaagaagagtggtgtgtcagttattggcaccagtacatcatgaatcctgctgggctgtggagaaaggagaaactaacctgaacaagactatactctacacagctgtccctgacattctaccacctgttagcattcagtattaatttcatggatcaaatcaaggcatgcaagtgcattaaataactttttaaaaaacaactgctgattgctgacgtctatgagggaagaaaaattaggggctgttattttcctatcaaccatcactctcattaacaagaacaggaaacattacgaataaataaaactcttacatcataccagaaaaaagaacagctgaatcccctaaaggatttcatattctatcatcagacaacgaaagaaaataattccatataaatggctgcatgaatcattgaaagaaacttccctgcttttttaaaagagcaactagaagtatttactttttgaaaatagagtaaccatttgttaaaccgtatataccattgaagatgttttgggtataaaagggaatttcccataataattacatagtaatcttttatagccaaagttatgaagaagatcaggatttgggaaaattgtggtcaatatttgattttccttttctgtttgatagccttatctaaattcccctagcttgaatgtagtaaatatgagtgtgtaaaaatgtgtatctaattcacctcttgggggaggtttaatgtaactataaataaaaattctttccccaggttaaaaa

SEQ ID NO: 436715 - DNA, 1247 bp, Homo sapiens
caaaagtagtttgtctttactaggccaccgtctcgtcagcgttacggagtattttgtccgcctgccgccgccgtcccagatattaatcacggagttccagggagaaggaacttgtgaaatgggggagccggctggggttgccggcaccatggagtcaccttttagcccgggactctttcacaggctggatgaagattgggattctgctctctttgctgaactcggttatttcacagacactgatgagctgcaattggaagcagcaaatgagacgtatgaaaacaattttgataatcttgattttgatttggatttgatgccttgggagtcagacatttgggacatcaacaaccaaatctgtacagttaaagatattaaggcagaaccccagccactttctccagcctcctcaagttattcagtctcgtctcctcggtcagtggactcttattcttcaactcagcatgttcctgaggagttggatttgtcttctagttctcagatgtctcccctttccttatatggtgaaaactctaatagtctctcttcagcggagccactgaaggaagataagcctgtcactggtcctaggaacaagactgaaaatggactgactccaaagaaaaaaattcaggtgaattcaaaaccttcaattcagcccaagcctttattgcttccagcagcacccaagactcaaacaaactccagtgttccagcaaaaaccatcattattcagacagtaccaacgcttatgccattggcaaagcagcaaccaattatcagtttacaacctgcacccactaaaggttgtcagcaccatccctgagtcattacaatagcaccctgcagctatgctggaaaactgagcgtgggaccctgccagactgaagagcaggtgagcaaaatgctgctttctgccttggtggcaggcagagaactgtctcgtactagaattcaaggaggaaagaagaagaaataaaagaagctgctccatttttcatcatctacccatctatttggaaagcactggaattcagatgcaagagaacaatgtttcttcagtggcaaatgtagccctgcatcctccagtgttacctggtgtagatttttttttctgtacctttctaaacctctcttccctctgtgatggttttgtgtttaaacagtcatcttcttttaaataatatccacctctcctttttgccatttcacttattgattcataaagtgaattttatttaaagcta

SEQ ID NO: 436716 - DNA, 1745 bp, Homo sapiens
caaaagtagtttgtctttactaggccaccgtctcgtcagcgttacggagtattttgtccgcctgccgccgccgtcccagatattaatcacggagttccagggagaaggaacttgtgaaatgggggagccggctggggttgccggcaccatggagtcaccttttagcccgggactctttcacaggctggatgaagattgggattctgctctctttgctgaactcggttatttcacagacactgatgagctgcaattggaagcagcaaatgagacgtatgaaaacaattttgataatcttgattttgatttggatttgatgccttgggagtcagacatttgggacatcaacaaccaaatctgtacagttaaagatattaaggcagaaccccagccactttctccagcctcctcaagttattcagtctcgtctcctcggtcagtggactcttattcttcaactcagcatgttcctgaggagttggatttgtcttctagttctcagatgtctcccctttccttatatggtgaaaactctaatagtctctcttcagcggagccactgaaggaagataagcctgtcactggtcctaggaacaagactgaaaatggactgactccaaagaaaaaaattcaggtgaattcaaaaccttcaattcagcccaagcctttattgcttccagcagcacccaagactcaaacaaactccagtgttccagcaaaaaccatcattattcagacagtaccaacgcttatgccattggcaaagcagcaaccaattatcagtttacaacctgcacccactaaaggccagacggttttgctgtctcagcctactgtggtacaacttcaagcacctggagttctgccctctgctcagccagtccttgctgttgctgggggagtcacacagctccctaatcacgtggtgaatgtggtaccagccccttcagcgaatagcccagtgaatggaaaactttccgtgactaaacctgtcctacaaagtaccatgagaaatgtcggttcagatattgctgtgctaaggagacagcaacgtatgataaaaaatcgagaatccgcttgtcagtctcgcaagaagaagaaagaatatatgctagggttagaggcgagattaaaggctgccctctcagaaaacgagcaactgaagaaagaaaatggaacactgaagcggcagctggatgaagttgtgtcagagaaccagaggcttaaagtccctagtccaaagcgaagagttgtctgtgtgatgatagtattggcatttataatactgaactatggacctatgagcatgttggaacaggattccaggagaatgaaccctagtgtgagccctgcaaatcaaaggaggcaccttctaggattttctgctaaagaggcacaggacacatcagatggtattatccagaaaaacagctacaggtaagatggcatgcatctatcttttggcctaagtgatttaatgaagctgaaacaagagaattatctgtagtataacattgcatctaaattgttcgtgtatattttgagtagtagaacacataaattactgaaaccattaatacattttacttttaatattgtaaaattaaatttactttgaaaccttttgtagttttaaaattcctatagagatgtaatcttaaaatctcagtttgtgtgcattaatatacatattgaaatatatacatattatatataatgtctttaataattattttatctatcat

SEQ ID NO: 436717 - DNA, 957 bp, Homo sapiens
  misc_feature (68)..(68): n is a, c, g, or t
gagagagagagagagagagagagagagagagagagagagagagagagagagagagagagagagagagnagagagagcatagtgcctgacaacggtagacactctgtaaatgtgtattacattaatgaatgaatgattctaagctggtttgtagttaattaagccaacttcaaataaaaactataatttttcatcatcccaacgaaatattgacctcttagaagccctgaatttggcctgttctaggactaagccaattgttatatataacagattgttctttgttaattttaggatcacctgctgttaccagctaccacccataacaagaccacaagaccaaaaatgtcaattgtgttaccagcaataaacataaatggtaagttgaaattctgatgtatgaacaatatgagatttctttgtttaaccaggattctcttcattagttcaaagacatttaaaatgttcagttaaatgagtatatatccgtacattatttcttgaaacatttttccactgttttattatttttaagaaccattattcttttaaaaaaaattactacatccctaaaagaaaaagtagctttcttttacttacaaaattggaaaagctagcatcttgactgctctacagacttgcatctgcgacccttctagtcataaatgtagtgtaagaagcccctgctgtgttctgacagtgaatttgtaaattagatttttggaactcaaagcagtttcctgtgttacctaaatgttgatatcatcctagaccatgccacagaagcctgtttatgtttaattgataatactgatgagtttgacactgatagtattactattgcattttgttatattactagccctggacattaaacaaaatacaaataataatataatgcacagatgttaaggcataatatacctgcttatagtttagaagaaaaaaaaagacaagc

SEQ ID NO: 436718 - DNA, 771 bp, Homo sapiens
gtttctaatatacctttcctttgaagttaccctgaagtgtttttctgtttatatgtgggtctcctccttttctatgcaatttgctgcttaaggattatactcattaatttttgtttttattatgctacaggaggagttggatttgtcttctagttctcagatgtctcccctttccttatatggtgaaaactctaatagtctctcttcagcggagccactgaaggaagataagcctgtcactggtcctaggaacaagactggtattactctatctcctaacttctgttatttctatttcagattgagcttaggttccatttcttaaaagaaaatgctggattaaatttatgtttattaggctggcttgctgttttttaattggtggacctatattgtttgttgtgagtgattaccgtggagaggaaaggggagaaataatctttggttgtctctgtctttacaggtgaaagatactttaaaatagactcagaccccaccatcttcaggagagatttcaaagtttcagttaaagataactgaatggagctatgacatttgttacctcattaatctctgggtgttatcccgtgattttagcaattctcctttaccagttagtgtgtcccattcccaaaactgcagcttggttagaaaaggaggtaacagtttaagtacttttcttcagttcattcaggtatatgtactgtagctatgcttaaactccagttaaagattgttaatcgaagttaagataatgtgtagagaaaggtg

SEQ ID NO: 436719 - DNA, 420 bp, Homo sapiens
tttagttgagaaagataaataagaaagtatattaaagtatattgttaatgataactcaaagagatgaatttagttggtcacattaaaaacataacaaagtcaccataagcgtgtgctgctattgatccaatgttttaattgatggtgtccaatcccttggtgttgatcttacccattacgtctgcagaaaagacctaattataagctgcttcccctgccacagtagttgtgtaccctttgattccttttcttttttctaacgcaggccagacggttttgctgtctcagcctactgtggtacaacttcaagcacctggagttctgccctctgctcagccagtccttgctgttgctgggggagtcacacagctccctaatcacgtggtgaatgtggtaccagccccttcagcgaatagccca

SEQ ID NO: 436720 - DNA, 3565 bp, Homo sapiens
caaaagtagtttgtctttactaggccaccgtctcgtcagcgttacggagtattttgtccgcctgccgccgccgtcccagatattaatcacggagttccagggagaaggaacttgtgaaatgggggagccggctggggttgccggcaccatggagtcaccttttagcccgggactctttcacaggctggatgaagattgggattctgctctctttgctgaactcggttatttcacagacactgatgagctgcaattggaagcagcaaatgagacgtatgaaaacaattttgataatcttgattttgatttggatttgatgccttgggagtcagacatttgggacatcaacaaccaaatctgtacagttaaagatattaaggcagaaccccagccactttctccagcctcctcaagttattcagtctcgtctcctcggtcagtggactcttattcttcaactcagcatgttcctgaggagttggatttgtcttctagttctcagatgtctcccctttccttatatggtgaaaactctaatagtctctcttcagcggagccactgaaggaagataagcctgtcactggtcctaggaacaagactgaaaatggactgactccaaagaaaaaaattcaggtgaattcaaaaccttcaattcagcccaagcctttattgcttccagcagcacccaagactcaaacaaactccagtgttccagcaaaaaccatcattattcagacagtaccaacgcttatgccattggcaaagcagcaaccaattatcagtttacaacctgcacccactaaaggccagacggttttgctgtctcagcctactgtggtacaacttcaagcacctggagttctgccctctgctcagccagtccttgctgttgctgggggagtcacacagctccctaatcacgtggtgaatgtggtaccagccccttcagcgaatagcccagtgaatggaaaactttccgtgactaaacctgtcctacaaagtaccatgagaaatgtcggttcagatattgctgtgctaaggagacagcaacgtatgataaaaaatcgagaatccgcttgtcagtctcgcaagaagaagaaagaatatatgctagggttagaggcgagattaaaggctgccctctcagaaaacgagcaactgaagaaagaaaatggaacactgaagcggcagctggatgaagttgtgtcagagaaccagaggcttaaagtccctagtccaaagcgaagagttgtctgtgtgatgatagtattggcatttataatactgaactatggacctatgagcatgttggaacaggattccaggagaatgaaccctagtgtgagccctgcaaatcaaaggaggcaccttctaggattttctgctaaagaggcacaggacacatcagatggtattatccagaaaaacagctacagatatgatcattctgtttcaaatgacaaagccctgatggtgctaactgaagaaccattgctttacattcctccacctccttgtcagcccctaattaacacaacagagtctctcaggttaaatcatgaacttcgaggatgggttcatagacatgaagtagaaaggaccaagtcaagaagaatgacaaataatcaacagaaaacccgtattcttcagggtgctctggaacagggctcaaattctcagctgatggctgttcaatacacagaaaccactagtagtatcagcaggaactcagggagtgagctacaagtgtattatgcttcacccagaagttatcaagacttttttgaagccatccgcagaaggggagacacattttatgttgtgtcatttcgaagggatcacctgctgttaccagctaccacccataacaagaccacaagaccaaaaatgtcaattgtgttaccagcaataaacataaatgagaatgtgatcaatgggcaggactacgaagtgatgatgcagattgactgtcaggtgatggacaccaggatcctccatatcaaaagttcgtcggttcctccttacctccgagatcagcagaggaatcaaaccaacaccttctttggctcccctcccgcagccacagaggcaacccacgttgtcagcaccatccctgagtcattacaatagcaccctgcagctatgctggaaaactgagcgtgggaccctgccagactgaagagcaggtgagcaaaatgctgctttctgccttggtggcaggcagagaactgtctcgtactagaattcaaggaggaaagaagaagaaataaaagaagctgctccatttttcatcatctacccatctatttggaaagcactggaattcagatgcaagagaacaatgtttcttcagtggcaaatgtagccctgcatcctccagtgttacctggtgtagatttttttttctgtacctttctaaacctctcttccctctgtgatggttttgtgtttaaacagtcatcttcttttaaataatatccacctctcctttttgccatttcacttattgattcataaagtgaattttatttaaagctatgccacacatgcatgttcaaatggtttccactgattcgatttttcattcatttaatgcaaacccattctggatattgtgcttatttgagaaaacacatttcaaaaccagaaaagccaaaaacactccaaaaacaagcaaaacaatttggagctttagataaaaggaaaaactcccagttggtaaagtttatctttacttaggatttgtggctcacacctaaacaaagggggtcagggagtgggtacaaatttgagaaaatagaagggtaagggaagggccagtggtggggtttggagagaggagatagctccattaatacacatgtttaaaagatggaaagttcacgcctgtaatcccagcactttgggaggccgaggcgggcggatcacgaggtcaggagatcaagaccatcccggctaaaacggtgaaaccccgtctctactaaaaatacaaaaaattagccgggcgtagtgacgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagatggaaagttcgatgtgactgcagtatgagattaaagccacaactattgtttattttggggactctaggccaccaagtattagcacacatacttatgttttctctactaatctggtccaggtcctcatggaccacaggacaaagctttcattttcattcattcttctattgaaattataccaaattcagctgaggaatatggaagtaactttagacttaaacaagacaaaagttttttcactgaagaattgacaagtatttgctccttaaaacaatgcagattagtgaacgtggattcctgctgagggagtgcatcccataatatggcaataattttcagtttctccaacgaaaagatagtgaaggaattaaatcttttgtcctcccatggttaaa

SEQ ID NO: 436721 - DNA, 3019 bp, Homo sapiens
cgaactcgcatggctggttagtccgaacttgcatgggctgggctagtcccgaacttgcatggctggttagaccgaacctgcatggctggtgaattcaaaaccttcaattcagcccaagcctttattgcttccagcagcacccaagactcaaacaaactccagtgttccagcaaaaaccatcattattcagacagtaccaacgcttatgccattggcaaagcagcaaccaattatcagtttacaacctgcacccactaaaggccagacggttttgctgtctcagcctactgtggtacaacttcaagcacctggagttctgccctctgctcagccagtccttgctgttgctgggggagtcacacagctccctaatcacgtggtgaatgtggtaccagccccttcagcgaatagcccagtgaatggaaaactttccgtgactaaacctgtcctacaaagtaccatgagaaatgtcggttcagatattgctgtgctaaggagacagcaacgtatgataaaaaatcgagaatccgcttgtcagtctcgcaagaagaagaaagaatatatgctagggttagaggcgagattaaaggctgccctctcagaaaacgagcaactgaagaaagaaaatggaacactgaagcggcagctggatgaagttgtgtcagagaaccagaggcttaaagtccctagtccaaagcgaagagttgtctgtgtgatgatagtattggcatttataatactgaactatggacctatgagcatgttggaacaggattccaggagaatgaaccctagtgtgagccctgcaaatcaaaggaggcaccttctaggattttctgctaaagaggcacaggacacatcagatggtattatccagaaaaacagctacagatatgatcattctgtttcaaatgacaaagccctgatggtgctaactgaagaaccattgctttacattcctccacctccttgtcagcccctaattaacacaacagagtctctcaggttaaatcatgaacttcgaggatgggttcatagacatgaagtagaaaggaccaagtcaagaagaatgacaaataatcaacagaaaacccgtattcttcagggtgctctggaacagggctcaaattctcagctgatggctgttcaatacacagaaaccactagtagtatcagcaggaactcagggagtgagctacaagtgtattatgcttcacccagaagttatcaagacttttttgaagccatccgcagaaggggagacacattttatgttgtgtcatttcgaagggatcacctgctgttaccagctaccacccataacaagaccacaagaccaaaaatgtcaattgtgttaccagcaataaacataaatgagaatgtgatcaatgggcaggactacgaagtgatgatgcagattgactgtcaggtgatggacaccaggatcctccatatcaaaagttcgtcggttcctccttacctccgagatcagcagaggaatcaaaccaacaccttctttggctcccctcccgcagccacagaggcaacccacgttgtcagcaccatccctgagtcattacaatagcaccctgcagctatgctggaaaactgagcgtgggaccctgccagactgaagagcaggtgagcaaaatgctgctttctgccttggtggcaggcagagaactgtctcgtactagaattcaaggaggaaagaagaagaaataaaagaagctgctccatttttcatcatctacccatctatttggaaagcactggaattcagatgcaagagaacaatgtttcttcagtggcaaatgtagccctgcatcctccagtgttacctggtgtagatttttttttctgtacctttctaaacctctcttccctctgtgatggttttgtgtttaaacagtcatcttcttttaaataatatccacctctcctttttgccatttcacttattgattcataaagtgaattttatttaaagctatgccacacatgcatgttcaaatggtttccactgattcgatttttcattcatttaatgcaaacccattctggatattgtgcttatttgagaaaacacatttcaaaaccagaaaagccaaaaacactccaaaaacaagcaaaacaatttggagctttagataaaaggaaaaactcccagttggtaaagtttatctttacttaggatttgtggctcacacctaaacaaagggggtcagggagtgggtacaaatttgagaaaatagaagggtaagggaagggccagtggtggggtttggagagaggagatagctccattaatacacatgtttaaaagatggaaagttcacgcctgtaatcccagcactttgggaggccgaggcgggcggatcacgaggtcaggagatcaagaccatcccggctaaaacggtgaaaccccgtctctactaaaaatacaaaaaattagccgggcgtagtgacgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagatggaaagttcgatgtgactgcagtatgagattaaagccacaactattgtttattttggggactctaggccaccaagtattagcacacatacttatgttttctctactaatctggtccaggtcctcatggaccacaggacaaagctttcattttcattcattcttctattgaaattataccaaattcagctgaggaatatggaagtaactttagacttaaacaagacaaaagttttttcactgaagaattgacaagtatttgctccttaaaacaatgcagattagtgaacgtggattcctgctgagggagtgcatcccataatatggcaataattttcagtttctccaacgaaaagatagtgaaggaattaaatcttttgtcctcccatggttaaa

SEQ ID NO: 436722 - DNA, 2273 bp, Homo sapiens
caaaagtagtttgtctttactaggccaccgtctcgtcagcgttacggagtattttgtccgcctgccgccgccgtcccagatattaatcacggagttccagggagaaggaacttgtgaaatgggggagccggctggggttgccggcaccatggagtcaccttttagcccgggactctttcacaggctggatgaagattgggattctgctctctttgctgaactcggttatttcacagacactgatgagctgcaattggaagcagcaaatgagacgtatgaaaacaattttgataatcttgattttgatttggatttgatgccttgggagtcagacatttgggacatcaacaaccaaatctgtacagttaaagatattaaggcagaaccccagccactttctccagcctcctcaagttattcagtctcgtctcctcggtcagtggactcttattcttcaactcagcatgttcctgaggagttggatttgtcttctagttctcagatgtctcccctttccttatatggtgaaaactctaatagtctctcttcagcggagccactgaaggaagataagcctgtcactggtcctaggaacaagactgaaaatggactgactccaaagaaaaaaattcaggtgaattcaaaaccttcaattcagcccaagcctttattgcttccagcagcacccaagactcaaacaaactccagtgttccagcaaaaaccatcattattcagacagtaccaacgcttatgccattggcaaagcagcaaccaattatcagtttacaacctgcacccactaaaggttgtcagcaccatccctgagtcattacaatagcaccctgcagctatgctggaaaactgagcgtgggaccctgccagactgaagagcaggtgagcaaaatgctgctttctgccttggtggcaggcagagaactgtctcgtactagaattcaaggaggaaagaagaagaaataaaagaagctgctccatttttcatcatctacccatctatttggaaagcactggaattcagatgcaagagaacaatgtttcttcagtggcaaatgtagccctgcatcctccagtgttacctggtgtagatttttttttctgtacctttctaaacctctcttccctctgtgatggttttgtgtttaaacagtcatcttcttttaaataatatccacctctcctttttgccatttcacttattgattcataaagtgaattttatttaaagctatgccacacatgcatgttcaaatggtttccactgattcgatttttcattcatttaatgcaaacccattctggatattgtgcttatttgagaaaacacatttcaaaaccagaaaagccaaaaacactccaaaaacaagcaaaacaatttggagctttagataaaaggaaaaactcccagttggtaaagtttatctttacttaggatttgtggctcacacctaaacaaagggggtcagggagtgggtacaaatttgagaaaatagaagggtaagggaagggccagtggtggggtttggagagaggagatagctccattaatacacatgtttaaaagatggaaagttcacgcctgtaatcccagcactttgggaggccgaggcgggcggatcacgaggtcaggagatcaagaccatcccggctaaaacggtgaaaccccgtctctactaaaaatacaaaaaattagccgggcgtagtgacgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagatggaaagttcgatgtgactgcagtatgagattaaagccacaactattgtttattttggggactctaggccaccaagtattagcacacatacttatgttttctctactaatctggtccaggtcctcatggaccacaggacaaagctttcattttcattcattcttctattgaaattataccaaattcagctgaggaatatggaagtaactttagacttaaacaagacaaaagttttttcactgaagaattgacaagtatttgctccttaaaacaatgcagattagtgaacgtggattcctgctgagggagtgcatcccataatatggcaataattttcagtttctccaacgaaaagatagtgaaggaattaaatcttttgtcctcccatggttaaa

SEQ ID NO: 436723 - DNA, 2501 bp, Homo sapiens
caaaagtagtttgtctttactaggccaccgtctcgtcagcgttacggagtattttgtccgcctgccgccgccgtcccagatattaatcacggagttccagggagaaggaacttgtgaaatgggggagccggctggggttgccggcaccatggagtcaccttttagcccgggactctttcacaggctggatgaagattgggattctgctctctttgctgaactcggttatttcacagacactgatgagctgcaattggaagcagcaaatgagacgtatgaaaacaattttgataatcttgattttgatttggatttgatgccttgggagtcagacatttgggacatcaacaaccaaatctgtacagttaaagatattaaggcagaaccccagccactttctccagcctcctcaagttattcagtctcgtctcctcggtcagtggactcttattcttcaactcagcatgttcctgaggagttggatttgtcttctagttctcagatgtctcccctttccttatatggtgaaaactctaatagtctctcttcagcggagccactgaaggaagataagcctgtcactggtcctaggaacaagactgaaaatggactgactccaaagaaaaaaattcaggtgaattcaaaaccttcaattcagcccaagcctttattgcttccagcagcacccaagactcaaacaaactccagtgttccagcaaaaaccatcattattcagacagtaccaacgcttatgccattggcaaagcagcaaccaattatcagtttacaacctgcacccactaaaggccagacggttttgctgtctcagcctactgtggtacaacttcaagcacctggagttctgccctctgctcagccagtccttgctgttgctgggggagtcacacagctccctaatcacgtggtgaatgtggtaccagccccttcagcgaatagcccagtgaatggaaaactttccgtgactaaacctgtcctacaaagtaccatgagaaatgtcggttcagatattgctgtgctaaggagacagcaacgtatgataaaaaatcgagaatccgcttgtcagtctcgcaagaagaagaaagaatatatgctagggttagaggcgagattaaaggctgccctctcagaaaacgagcaactgaagaaagaaaatggaacactgaagcggcagctggatgaagttgtgtcagagaaccagaggcttaaagtccctagtccaaagcgaagagttgtctgtgtgatgatagtattggcatttataatactgaactatggacctatgagcatgttggaacaggattccaggagaatgaaccctagtgtgagccctgcaaatcaaaggaggcaccttctaggattttctgctaaagaggcacaggacacatcagatggtattatccagaaaaacagctacagatatgatcattctgtttcaaatgacaaagccctgatggtgctaactgaagaaccattgctttacattcctccacctccttgtcagcccctaattaacacaacagagtctctcaggttaaatcatgaacttcgaggatgggttcatagacatgaagtagaaaggaccaagtcaagaagaatgacaaataatcaacagaaaacccgtattcttcagggtgctctggaacagggctcaaattctcagctgatggctgttcaatacacagaaaccactagtagtatcagcaggaactcagggagtgagctacaagtgtattatgcttcacccagaagttatcaagacttttttgaagccatccgcagaaggggagacacattttatgttgtgtcatttcgaagggatcacctgctgttaccagctaccacccataacaagaccacaagaccaaaaatgtcaattgtgttaccagcaataaacataaatggtaagttgaaattctgatgtatgaacaatatgagatttctttgtttaaccaggattctcttcattagttcaaagacatttaaaatgttcagttaaatgagtatatatccgtacattatttcttgaaacatttttccactgttttattatttttaagaaccattattcttttaaaaaaaattactacatccctaaaagaaaaagtagctttcttttacttacaaaattggaaaagctagcatcttgactgctctacagacttgcatctgcgacccttctagtcataaatgtagtgtaagaagcccctgctgtgttctgacagtgaatttgtaaattagatttttggaactcaaagcagtttcctgtgttacctaaatgttgatatcatcctagaccatgccacagaagcctgtttatgtttaattgataatactgatgagtttgacactgatagtattactattgcattttgttatattactagccctggacattaaacaaaatacaaataataatataatgcacagatgttaaggcataatatacctgcttatagtttagaagaaaaaaaaagacaagc

SEQ ID NO: 436724 - DNA, 494 bp, Homo sapiens
ttgcagtacctcctagaggccacaggggggagagcgcggggccctcccagggaggacgctccgtcctcgctgcacagagagcttcccggagcgtgggtgggggtggaaacccgtggggagctgaagtctcctcagcccagtcactgaggcaccgggggagacgcggaggaagaaagcaccattgagaattatgcgtcacgacccgaggcctttaacaccccgttcctgaacatcgacaaattgcgatctgcgtttaaggctgatgagttcctgaactggcacgccctctttgagtctatcaaaaggaaacttcctttcctcaactgggatgcctttcctaagctgaaaggactgaggagcgcaactcctgatgcccagtgaccatgacctccactggaagagggggctagcgtgagcgctgattctcaacctaccataactctttcctgcctcaggaactccaataaaacattttccatccaacaaaacaagta

SEQ ID NO: 436725 - DNA, 392 bp, Homo sapiens
gagcaccccaaacttgacgccatgaagatcccggtccttcctgccgtggtgctcctctccctcctggtgctccactctgcccagggagccaccctgggtggtcctgaggaagaaagcaccattgagaattatgcgtcacgacccgaggcgtttaaggctgatgagttcctgaactggcacgccctctttgagtctatcaaaaggaaacttcctttcctcaactgggatgcctttcctaagctgaaaggactgaggagcgcaactcctgatgcccagtgaccatgacctccactggaagagggggctagcgtgagcgctgattctcaacctaccataactctttcctgcctcaggaactccaataaaacattttccatccaacaaaacaagta

SEQ ID NO: 436726 - DNA, 319 bp, Homo sapiens
acagggaaaggaggatcagccttctcaccaaactgaagggaggtcttagctactacatatagaggagaacgggaactcacaccgaggcagaaattcctttccatccatgccatcctatactgggcacccacgggttccccatctaaccctgacccctctccctctagctgaaaggactgaggagcgcaactcctgatgcccagtgaccatgacctccactggaagagggggctagcgtgagcgctgattctcaacctaccataactctttcctgcctcaggaactccaataaaacattttccatccaacaaaacaagta

SEQ ID NO: 436727 - DNA, 434 bp, Homo sapiens
gagcaccccaaacttgacgccatgaagatcccggtccttcctgccgtggtgctcctctccctcctggtgctccactctgcccagggagccaccctgggtggtcctgaggaagaaagcaccattgagaattatgcgtcacgacccgaggcctttaacaccccgttcctgaacatcgacaaattgcgatctgcgtttaaggctgatgagttcctgaactggcacgccctctttgagtctatcaaaaggaaacttcctttcctcaactgggatgcctttcctaagctgaaaggactgaggagcgcaactcctgatgcccagtgaccatgacctccactggaagagggggctagcgtgagcgctgattctcaacctaccataactctttcctgcctcaggaactccaataaaacattttccatccaacaaaacaagta

SEQ ID NO: 436728 - DNA, 4353 bp, Homo sapiens
ggcagagggtgggccttaggacgggtctcccttaaactgggcgatcaggcagcgaccctagaggcgtctgtagggtaaagctgggggttctgtagccggaggcggcggcgagtccagaacgtcctggccttacagggagaaggcgtcactcgcggttacaagtgcctgaccctcactccagttggcggaggaggagaaggaaggggccgggccgggtcccctcccctcgcgccccggatggatgtgcccggcccggtgtctcggcgggcggcggcggcggcggccactgtgctcctgcggaccgctcgggtccgtcgcgaatgctggttcttgccgaccgcgctgctctgcgcctacggcttcttcgccagcctcaggccgtccgagcccttcctgaccccgtacctgctggggccggacaagaacctgaccgagagggaggtcttcaatgaaatttatccagtatggacttactcttacctggtgctactgtttcctgtgttccttgccacagactacctccgttataaacctgttgttctactgcaggggctcagccttattgttacatggtttatgctgctctatgcccagggactgctggccattcaatttctagaatttttttatggcatcgccacagccactgaaattgcctattactcttatatctacagtgtggtggacctgggcatgtaccagaaagtcacaagttactgtcgaagtgccactttggtgggctttacagtgggctctgtcctagggcaaatccttgtctcagtggcaggctggtcgctgttcagcctgaatgtcatctctcttacctgtgtttcagtggcttttgctgtggcctggtttttacctatgccacagaagagcctcttctttcaccacattccttctacctgccagagagtgaatggcatcaaggtacaaaatggtggcattgttactgacaccccagcttctaaccaccttcctggctgggaggacattgagtcaaaaatccctctaaatatggaggagcctcccgtggaggaaccggaacccaagccagaccgtctccttgtattgaaagtactatggaatgatttcctgatgtgctactcctctcgccctcttctctgctggtctgtgtggtgggccctctctacctgtggctattttcaagttgtgaactacacacagggcctgtgggagaaagtgatgccttctcgctatgctgctatctataatggtggcgtggaggccgtttcaaccttactgggtgctgttgctgtgtttgcagttggttatataaaaatatcctggtcaacttggggagaaatgacattatctctcttttctctcctgattgctgctgcagtgtatatcatggacactgtgggtaacatttgggtgtgctatgcatcctatgttgtcttcagaatcatctacatgttactcatcacgatagcaacttttcaaattgctgcaaacctcagcatggaacgctatgccctagtatttggtgtaaataccttcattgccctggcactgcagacgctgctcactctaattgtggtagatgccagtggccttggattagaaattaccactcagtttttgatctatgccagttattttgcactcatcgctgtggttttcctggccagtggtgcagtcagtgttatgaagaaatgtagaaagctggaagatccacaatcaagttctcaagtaaccacttcataatatactgctgaagggcttcttcttatagcaagaactctgcacagcaactgcctggatgtatttgattttttaaagcgtagacatatatttatgaatgtgcatttcttgacttcacagcagccacttgactaataccttgtgttccgggaataacatgatactattcagaggagccagaagtaaagtttatttcatggattatttatgagagctaatttaaggatgactttttttctgattcaaaagtgaacttgattttaaaaaccagtcaagagcaatcaaagcagcacatggtgttgtatacttcattagcaagtgagtttggtgttttataggtcacatatgtctgtatctacttagccagatgcttggcctggtgggaccagggctccacagaggccacaaaatgttgcaagtcatgatggatggaaatatgttctaacagcatctgcctctattcaatttaattcttatttctgtgttactcatgtacattggtctttctacatagttattctatcactggcaatatttgttctggtttagtgttctgtattttaaggtgtacgtatcatttctaattttaagttattttaaaaaaattcatcatatgaatgttcttggttcccattgtgacgattatttatttctgtaaaatttgtttagaagtacgtttttgcattattcatatgcttcccagagaagctcatttagttagaaaataaggcaagttttgaagcctgctaaatgaagagacttaagaaagcttaaggtacgcttgcttgtctttaaatcttcaatatgaaggactattaattccaagattaaaagttcatatataggctaaagatgtaactaggccatttgtatttgtattcccttttatttccaaaataaaatgaaaaatctttttttaataatttcatccctatttatagtttttatattaatttgtttttcttatccaagtaaagatgtcaataggaattgcattagtccaaggcctttttcataaactgagcctcttttcaattatttcaatgggacaggaactaggatagatgtgattcctgcatttttttaccttaaatctgcctttgtttctaaaggtagatcatcttgaatatttgcttaaaattgctagtgatttcattaccaagttacttgaaaaaatgttctatatgcatttaattctgaaatcagtctaccaaggggctgctagtatatgtcagacatgaaaactattttaaagctgactttgttgccttatcttgaaaagaatctagataggtgcttttaactggggtattaacttttttagaatgacacagctgaacagtgttaataatagtgtgtcaagattgcaaagtcgacatactcatttggtttaagcaggaatcctagaagcaaatggatggggataagaataggtcattttctattcaccatcctttactattaagggaaaggaaaagaacactagctaaggaagggaaagggaagtgatatcataaaagtagcaaccttcattttacattctgtctgtttttctttttttgctttgttttgtttgtgctaatttgggaattgtgtactccgaaacaagtagaaaagtgctgtttgagggattttattaaatctttttttaatggaatgtggtacaaattgttcatgttaccaaagcaatatttccctggaatttaattcaaagtttgtggcatacaacctgagccttttcttatataagacaagaatatgttcacatcttggtatgtggccatatttatagaatgctgaactcaatgtgcaagttgtactgtatgcagttttgtaaataagtgaaaataatttgttgtactttttattcaattctgtatagattataaaattatttttattaaataaatattttacagtatattttctctttttaatcaaaattgttttaaatttatcttctatttcagtaggagctttagattatatctttaaatattttaataatttatcctaggacaaatttcatattaagtcttcccctggtctaacttgcctagttaaccttttgttatctttttaattattccattgctttgtgatttttacctttgactcttcccccttatttcagatgttttcccccttttttttggcaccccgttgcactgtttttttttttttttttggttttcatgttggcactgctcttatctctttttaaagcattcttccttaaaaaaaaaaaaagacactctctttgatgttaactgaatttttacaataaaggaaattaaagcaagagcagaaaataccaccttgttctgaaacttcatagcctctttgttccacctcaaattattctgatacccagggaggaatcttcttgccatgagttgagaatcatttgtccattatatcccagaaacctaatcagtattttcttacagtatccaaatgagtaccattttttaatataccatttcaaaatctacttaaggcattgatttcgctgcttatcaccaaagtcctggaaatttttcatgcaaaaataaattttttttttttgagacagtcttgcactgttgcccaggctgcagtgcagtggcaatctcggctcactgc

SEQ ID NO: 436729 - DNA, 3987 bp, Homo sapiens
ggcagagggtgggccttaggacgggtctcccttaaactgggcgatcaggcagcgaccctagaggcgtctgtagggtaaagctgggggttctgtagccggaggcggcggcgagtccagaacgtcctggccttacagggagaaggcgtcactcgcggttacaagtgcctgaccctcactccagttggcggaggaggagaaggaaggggccgggccgggtcccctcccctcgcgccccggatggatgtgcccggcccggtgtctcggcgggcggcggcggcggcggccactgtgctcctgcggaccgctcgggtccgtcgcgaatgctggttcttgccgaccgcgctgctctgcgcctacggcttcttcgccagcctcaggccgtccgagcccttcctgaccccgtacctgctggggccggacaagaacctgaccgagagggaggtcttcaatgaaatttatccagtatggacttactcttacctggtgctactgtttcctgtgttccttgccacagactacctccgttataaacctgttgttctactgcaggggctcagccttattgttacatggtttatgctgctctatgcccagggactgctggccattcaatttctagaatttttttatggcatcgccacagccactgaaattgcctattactcttatatctacagtgtggtggacctgggcatgtaccagaaagtcacaagttactgtcgaagtgccactttggtgggctttacagtgggctctgtcctagggcaaatccttgtctcagtggcaggctggtcgctgttcagcctgaatgtcatctctcttacctgtgtttcagtggcttttgctgtggcctggtttttacctatgccacagaagagcctcttctttcaccacattccttctacctgccagagagtgaatggcatcaaggtacaaaatggtggcattgttactgacaccccagcttctaaccaccttcctggctgggaggacattgagtcaaaaatccctctaaatatggaggagcctcccgtggaggaaccggaacccaagccagaccgtctccttgtattgaaagtactatggaatgatttcctgatgtgctactcctctcgccctcttctctgctggtctgtgtggtgggccctctctacctgtggctattttcaagttgtgaactacacacagggcctgtgggagaaagtgatgccttctcgctatgctgctatctataatggtggcgtggaggccgtttcaaccttactgggtgctgttgctgtgtttgcagttggttatataaaaatatcctggtcaacttggggagaaatgacattatctctcttttctctcctgattgctgctgcagtgtatatcatggacactgtgggtaacatttgggtgtgctatgcatcctatgttgtcttcagaatcatctacatgttactcatcacgatagcaacgtatgtattttggctcatagaagccttaggaaaaattgtaacaggataaattttttggtttctttacaaaccatgtgcattatcagtttttctcctgaggaagcatttaggcaagttttgtttattcccatgtttgtatgttcctactgttttcagatgtttgcatgagatttatatcatttagttgcagaatgttttcatttggttggaaaggcaattgacagtagaaagaaggactcttcatgtttaaagataaatgtttacttttatttagaataaatattataagtactccagaagtaattcttatttattcactcttttatttttttttaagttttcaaattgctgcaaacctcagcatggaacgctatgccctagtatttggtgtaaataccttcattgccctggcactgcagacgctgctcactctaattgtggtagatgccagtggccttggattagaaattaccactcagtttttgatctatgccagttattttgcactcatcgctgtggttttcctggccagtggtgcagtcagtgttatgaagaaatgtagaaagctggaagatccacaatcaagttctcaagtaaccacttcataatatactgctgaagggcttcttcttatagcaagaactctgcacagcaactgcctggatgtatttgattttttaaagcgtagacatatatttatgaatgtgcatttcttgacttcacagcagccacttgactaataccttgtgttccgggaataacatgatactattcagaggagccagaagtaaagtttatttcatggattatttatgagagctaatttaaggatgactttttttctgattcaaaagtgaacttgattttaaaaaccagtcaagagcaatcaaagcagcacatggtgttgtatacttcattagcaagtgagtttggtgttttataggtcacatatgtctgtatctacttagccagatgcttggcctggtgggaccagggctccacagaggccacaaaatgttgcaagtcatgatggatggaaatatgttctaacagcatctgcctctattcaatttaattcttatttctgtgttactcatgtacattggtctttctacatagttattctatcactggcaatatttgttctggtttagtgttctgtattttaaggtgtacgtatcatttctaattttaagttattttaaaaaaattcatcatatgaatgttcttggttcccattgtgacgattatttatttctgtaaaatttgtttagaagtacgtttttgcattattcatatgcttcccagagaagctcatttagttagaaaataaggcaagttttgaagcctgctaaatgaagagacttaagaaagcttaaggtacgcttgcttgtctttaaatcttcaatatgaaggactattaattccaagattaaaagttcatatataggctaaagatgtaactaggccatttgtatttgtattcccttttatttccaaaataaaatgaaaaatctttttttaataatttcatccctatttatagtttttatattaatttgtttttcttatccaagtaaagatgtcaataggaattgcattagtccaaggcctttttcataaactgagcctcttttcaattatttcaatgggacaggaactaggatagatgtgattcctgcatttttttaccttaaatctgcctttgtttctaaaggtagatcatcttgaatatttgcttaaaattgctagtgatttcattaccaagttacttgaaaaaatgttctatatgcatttaattctgaaatcagtctaccaaggggctgctagtatatgtcagacatgaaaactattttaaagctgactttgttgccttatcttgaaaagaatctagataggtgcttttaactggggtattaacttttttagaatgacacagctgaacagtgttaataatagtgtgtcaagattgcaaagtcgacatactcatttggtttaagcaggaatcctagaagcaaatggatggggataagaataggtcattttctattcaccatcctttactattaagggaaaggaaaagaacactagctaaggaagggaaagggaagtgatatcataaaagtagcaaccttcattttacattctgtctgtttttctttttttgctttgttttgtttgtgctaatttgggaattgtgtactccgaaacaagtagaaaagtgctgtttgagggattttattaaatctttttttaatggaatgtggtacaaattgttcatgttaccaaagcaatatttccctggaatttaattcaaagtttgtggcatacaacctgagccttttcttatataagacaagaatatgttcacatcttggtatgtggccatatttatagaatgctgaactcaatgtgcaagttgtactgtatgcagttttgtaaataagtgaaaataatttgttgtactttttattcaattctgtatagattataaaattatttttattaaataaatattttacagtat

SEQ ID NO: 436730 - DNA, 3384 bp, Homo sapiens
ggcagagggtgggccttaggacgggtctcccttaaactgggcgatcaggcagcgaccctagaggcgtctgtagggtaaagctgggggttctgtagccggaggcggcggcgagtccagaacgtcctggccttacagggagaaggcgtcactcgcggttacaagtgcctgaccctcactccagttggcggaggaggagaaggaaggggccgggccgggtcccctcccctcgcgccccggatggatgtgcccggcccggtgtctcggcgggcggcggcggcggcggccactgtgctcctgcggaccgctcgggtccgtcgcgaatgctggttcttgccgaccgcgctgctctgcgcctacggcttcttcgccagcctcaggccgtccgagcccttcctgaccccgtacctgctggggccggacaagaacctgaccgagagggaggaacccaagccagaccgtctccttgtattgaaagtactatggaatgatttcctgatgtgctactcctctcgccctcttctctgctggtctgtgtggtgggccctctctacctgtggctattttcaagttgtgaactacacacagggcctgtgggagaaagtgatgccttctcgctatgctgctatctataatggtggcgtggaggccgtttcaaccttactgggtgctgttgctgtgtttgcagttggttatataaaaatatcctggtcaacttggggagaaatgacattatctctcttttctctcctgattgctgctgcagtgtatatcatggacactgtgggtaacatttgggtgtgctatgcatcctatgttgtcttcagaatcatctacatgttactcatcacgatagcaacgtatgtattttggctcatagaagccttaggaaaaattgtaacaggataaattttttggtttctttacaaaccatgtgcattatcagtttttctcctgaggaagcatttaggcaagttttgtttattcccatgtttgtatgttcctactgttttcagatgtttgcatgagatttatatcatttagttgcagaatgttttcatttggttggaaaggcaattgacagtagaaagaaggactcttcatgtttaaagataaatgtttacttttatttagaataaatattataagtactccagaagtaattcttatttattcactcttttatttttttttaagttttcaaattgctgcaaacctcagcatggaacgctatgccctagtatttggtgtaaataccttcattgccctggcactgcagacgctgctcactctaattgtggtagatgccagtggccttggattagaaattaccactcagtttttgatctatgccagttattttgcactcatcgctgtggttttcctggccagtggtgcagtcagtgttatgaagaaatgtagaaagctggaagatccacaatcaagttctcaagtaaccacttcataatatactgctgaagggcttcttcttatagcaagaactctgcacagcaactgcctggatgtatttgattttttaaagcgtagacatatatttatgaatgtgcatttcttgacttcacagcagccacttgactaataccttgtgttccgggaataacatgatactattcagaggagccagaagtaaagtttatttcatggattatttatgagagctaatttaaggatgactttttttctgattcaaaagtgaacttgattttaaaaaccagtcaagagcaatcaaagcagcacatggtgttgtatacttcattagcaagtgagtttggtgttttataggtcacatatgtctgtatctacttagccagatgcttggcctggtgggaccagggctccacagaggccacaaaatgttgcaagtcatgatggatggaaatatgttctaacagcatctgcctctattcaatttaattcttatttctgtgttactcatgtacattggtctttctacatagttattctatcactggcaatatttgttctggtttagtgttctgtattttaaggtgtacgtatcatttctaattttaagttattttaaaaaaattcatcatatgaatgttcttggttcccattgtgacgattatttatttctgtaaaatttgtttagaagtacgtttttgcattattcatatgcttcccagagaagctcatttagttagaaaataaggcaagttttgaagcctgctaaatgaagagacttaagaaagcttaaggtacgcttgcttgtctttaaatcttcaatatgaaggactattaattccaagattaaaagttcatatataggctaaagatgtaactaggccatttgtatttgtattcccttttatttccaaaataaaatgaaaaatctttttttaataatttcatccctatttatagtttttatattaatttgtttttcttatccaagtaaagatgtcaataggaattgcattagtccaaggcctttttcataaactgagcctcttttcaattatttcaatgggacaggaactaggatagatgtgattcctgcatttttttaccttaaatctgcctttgtttctaaaggtagatcatcttgaatatttgcttaaaattgctagtgatttcattaccaagttacttgaaaaaatgttctatatgcatttaattctgaaatcagtctaccaaggggctgctagtatatgtcagacatgaaaactattttaaagctgactttgttgccttatcttgaaaagaatctagataggtgcttttaactggggtattaacttttttagaatgacacagctgaacagtgttaataatagtgtgtcaagattgcaaagtcgacatactcatttggtttaagcaggaatcctagaagcaaatggatggggataagaataggtcattttctattcaccatcctttactattaagggaaaggaaaagaacactagctaaggaagggaaagggaagtgatatcataaaagtagcaaccttcattttacattctgtctgtttttctttttttgctttgttttgtttgtgctaatttgggaattgtgtactccgaaacaagtagaaaagtgctgtttgagggattttattaaatctttttttaatggaatgtggtacaaattgttcatgttaccaaagcaatatttccctggaatttaattcaaagtttgtggcatacaacctgagccttttcttatataagacaagaatatgttcacatcttggtatgtggccatatttatagaatgctgaactcaatgtgcaagttgtactgtatgcagttttgtaaataagtgaaaataatttgttgtactttttattcaattctgtatagattataaaattatttttattaaataaatattttacagtat

SEQ ID NO: 436731 - DNA, 1764 bp, Homo sapiens
gagagagagagagagagagagagagagagagagagagagagagagagagagagagagagagagagagagagagagagagagagagagagagagagcttgattttaaaaaccagtcaagagcaatcaaagcagcacatggtgttgtatacttcattagcaagtgagtttggtgttttataggtcacatatgtctgtatctacttagccagatgcttggcctggtgggaccagggctccacagaggccacaaaatgttgcaagtcatgatggatggaaatatgttctaacagcatctgcctctattcaatttaattcttatttctgtgttactcatgtacattggtctttctacatagttattctatcactggcaatatttgttctggtttagtgttctgtattttaaggtgtacgtatcatttctaattttaagttattttaaaaaaattcatcatatgaatgttcttggttcccattgtgacgattatttatttctgtaaaatttgtttagaagtacgtttttgcattattcatatgcttcccagagaagctcatttagttagaaaataaggcaagttttgaagcctgctaaatgaagagacttaagaaagcttaaggtacgcttgcttgtctttaaatcttcaatatgaaggactattaattccaagattaaaagttcatatataggctaaagatgtaactaggccatttgtatttgtattcccttttatttccaaaataaaatgaaaaatctttttttaataatttcatccctatttatagtttttatattaatttgtttttcttatccaagtaaagatgtcaataggaattgcattagtccaaggcctttttcataaactgagcctcttttcaattatttcaatgggacaggaactaggatagatgtgattcctgcatttttttaccttaaatctgcctttgtttctaaaggtagatcatcttgaatatttgcttaaaattgctagtgatttcattaccaagttacttgaaaaaatgttctatatgcatttaattctgaaatcagtctaccaaggggctgctagtatatgtcagacatgaaaactattttaaagctgactttgttgccttatcttgaaaagaatctagataggtgcttttaactggggtattaacttttttagaatgacacagctgaacagtgttaataatagtgtgtcaagattgcaaagtcgacatactcatttggtttaagcaggaatcctagaagcaaatggatggggataagaataggtcattttctattcaccatcctttactattaagggaaaggaaaagaacactagctaaggaagggaaagggaagtgatatcataaaagtagcaaccttcattttacattctgtctgtttttctttttttgctttgttttgtttgtgctaatttgggaattgtgtactccgaaacaagtagaaaagtgctgtttgagggattttattaaatctttttttaatggaatgtggtacaaattgttcatgttaccaaagcaatatttccctggaatttaattcaaagtttgtggcatacaacctgagccttttcttatataagacaagaatatgttcacatcttggtatgtggccatatttatagaatgctgaactcaatgtgcaagttgtactgtatgcagttttgtaaataagtgaaaataatttgttgtactttttattcaattctgtatagattataaaattatttttattaaataaatattttacagtat

SEQ ID NO: 436732 - DNA, 2537 bp, Homo sapiens
ggcagagggtgggccttaggacgggtctcccttaaactgggcgatcaggcagcgaccctagaggcgtctgtagggtaaagctgggggttctgtagccggaggcggcggcgagtccagaacgtcctggccttacagggagaaggcgtcactcgcggttacaagtgcctgaccctcactccagttggcggaggaggagaaggaaggggccgggccgggtcccctcccctcgcgccccggatggatgtgcccggcccggtgtctcggcgggcggcggcggcggcggccactgtgctcctgcggaccgctcgggtccgtcgcgaatgctggttcttgccgaccgcgctgctctgcgcctacggcttcttcgccagcctcaggccgtccgagcccttcctgaccccgtacctgctggggccggacaagaacctgaccgagagggaggtcttcaatgaaatttatccagtatggacttactcttacctggtgctactgtttcctgtgttccttgccacagactacctccgttataaacctgttgttctactgcaggggctcagccttattgttacatggtttatgctgctctatgcccagggactgctggccattcaatttctagaatttttttatggcatcgccacagccactgaaattgcctattactcttatatctacagtgtggtggacctgggcatgtaccagaaagtcacaagttactgtcgaagtgccactttggtgggctttacagtgggctctgtcctagggcaaatccttgtctcagtggcaggctggtcgctgttcagcctgaatgtcatctctcttacctgtgtttcagtggcttttgctgtggcctggtttttacctatgccacagaagagcctcttctttcaccacattccttctacctgccagagagtgaatggcatcaaggtacaaaatggtggcattgttactgacaccccagcttctaaccaccttcctggctgggaggacattgagtcaaaaatccctctaaatatggaggagcctcccgtggaggaaccggaacccaagccagaccgtctccttgtattgaaagtactatggaatgatttcctgatgtgctactcctctcgccctcttctctgctggtctgtgtggtgggccctctctacctgtggctattttcaagttgtgaactacacacagggcctgtgggagaaagtgatgccttctcgctatgctgctatctataatggtggcgtggaggccgtttcaaccttactgggtgctgttgctgtgtttgcagttggttatataaaaatatcctggtcaacttggggagaaatgacattatctctcttttctctcctgattgctgctgcagtgtatatcatggacactgtgggtaacatttgggtgtgctatgcatcctatgttgtcttcagaatcatctacatgttactcatcacgatagcaacgtatgtattttggctcatagaagccttaggaaaaattgtaacaggataaattttttggtttctttacaaaccatgtgcattatcagtttttctcctgaggaagcatttaggcaagttttgtttattcccatgtttgtatgttcctactgttttcagatgtttgcatgagatttatatcatttagttgcagaatgttttcatttggttggaaaggcaattgacagtagaaagaaggactcttcatgtttaaagataaatgtttacttttatttagaataaatattataagtactccagaagtaattcttatttattcactcttttatttttttttaagttttcaaattgctgcaaacctcagcatggaacgctatgccctagtatttggtgtaaataccttcattgccctggcactgcagacgctgctcactctaattgtggtagatgccagtggccttggattagaaattaccactcaggtaagatctctcctttggcatcgaaggtagtatgtgtgacttgatcagggtgacagaagtatatgtatgcttaatgcaaatccaaacaatagggaacagatgtaaagtgcataccctccttccttcattcaacatcttctcccctatccttaggtgtttctcctgggagggtgttgggattgtcaggtcttagaacattcccgagtgtctcatcagcccaatggggctgtttcagctgagaggtaatattgattccttacagaccaagaccttctgcttcctcatccattatttccctctatacttaaatctatgcttggaatactgtatcccatgtttgagattccctgcttcatctcacaactctttaagtctcctcccttctttatttaaaacacccctcacccaaataccacggtaatgcctcgctgctgatgaacaacattatgatttgtaacttatgactattgagaaacttgcaccaacacccaacaacaatgtgaatactttttacgttcaggaattgtatagttgtatatgccttcatgcattgtgagttttaagtatatcttgttttgtactttggtaaaatgggcaa

SEQ ID NO: 436733 - DNA, 452 bp, Homo sapiens
ctgcagtgtatatcatggacactgtgggtaacatttgggtgtgctatgcatcctatgttgtcttcagaatcatctacatgttactcatcacgatagcaacgtatgtattttggctcatagaagccttaggaaaaattgtaacaggataaattttttggtttctttacaaaccaaaatattcaagtttctagttaaatgaggcaaatgggaggaagcattgtattatatgtgcattatcagtttttctcctgaggaagcatttaggcaagttttgtttattcccatgtttgtatgttcctactgttttcagatgtttgcatgagatttatatcatttagttgcagaatgttttcatttggttggaaaggcaattgacagtagaaagaaggactcttcatgtttaaagataaatgtttacttttatttagaataaatattataagtactccaga

SEQ ID NO: 436734 - DNA, 3650 bp, Homo sapiens
ggcagagggtgggccttaggacgggtctcccttaaactgggcgatcaggcagcgaccctagaggcgtctgtagggtaaagctgggggttctgtagccggaggcggcggcgagtccagaacgtcctggccttacagggagaaggcgtcactcgcggttacaagtgcctgaccctcactccagttggcggaggaggagaaggaaggggccgggccgggtcccctcccctcgcgccccggatggatgtgcccggcccggtgtctcggcgggcggcggcggcggcggccactgtgctcctgcggaccgctcgggtccgtcgcgaatgctggttcttgccgaccgcgctgctctgcgcctacggcttcttcgccagcctcaggccgtccgagcccttcctgaccccgtacctgctggggccggacaagaacctgaccgagagggaggtcttcaatgaaatttatccagtatggacttactcttacctggtgctactgtttcctgtgttccttgccacagactacctccgttataaacctgttgttctactgcaggggctcagccttattgttacatggtttatgctgctctatgcccagggactgctggccattcaatttctagaatttttttatggcatcgccacagccactgaaattgcctattactcttatatctacagtgtggtggacctgggcatgtaccagaaagtcacaagttactgtcgaagtgccactttggtgggctttacagtgggctctgtcctagggcaaatccttgtctcagtggcaggctggtcgctgttcagcctgaatgtcatctctcttacctgtgtttcagtggcttttgctgtggcctggtttttacctatgccacagaagagcctcttctttcaccacattccttctacctgccagagagtgaatggcatcaaggtacaaaatggtggcattgttactgacaccccagcttctaaccaccttcctggctgggaggacattgagtcaaaaatccctctaaatatggaggagcctcccgtggaggaaccggaacccaagccagaccgtctccttgtattgaaagtactatggaatgatttcctgatgtgctactcctctcgccctcttctctgctggtctgtgtggtgggccctctctacctgtggctattttcaagttgtgaactacacacagggcctgtgggagaaagtgatgccttctcgctatgctgctatctataatggtggcgtggaggccgtttcaaccttactgggtgctgttgctgtgtttgcagttggttatataaaaatatcctggtcaacttggggagaaatgacattatctctcttttctctcctgattgctgctgcagtgtatatcatggacactgtgggtaacatttgggtgtgctatgcatcctatgttgtcttcagaatcatctacatgttactcatcacgatagcaacttttcaaattgctgcaaacctcagcatggaacgctatgccctagtatttggtgtaaataccttcattgccctggcactgcagacgctgctcactctaattgtggtagatgccagtggccttggattagaaattaccactcagtttttgatctatgccagttattttgcactcatcgctgtggttttcctggccagtggtgcagtcagtgttatgaagaaatgtagaaagctggaagatccacaatcaagttctcaagtaaccacttcataatatactgctgaagggcttcttcttatagcaagaactctgcacagcaactgcctggatgtatttgattttttaaagcgtagacatatatttatgaatgtgcatttcttgacttcacagcagccacttgactaataccttgtgttccgggaataacatgatactattcagaggagccagaagtaaagtttatttcatggattatttatgagagctaatttaaggatgactttttttctgattcaaaagtgaacttgattttaaaaaccagtcaagagcaatcaaagcagcacatggtgttgtatacttcattagcaagtgagtttggtgttttataggtcacatatgtctgtatctacttagccagatgcttggcctggtgggaccagggctccacagaggccacaaaatgttgcaagtcatgatggatggaaatatgttctaacagcatctgcctctattcaatttaattcttatttctgtgttactcatgtacattggtctttctacatagttattctatcactggcaatatttgttctggtttagtgttctgtattttaaggtgtacgtatcatttctaattttaagttattttaaaaaaattcatcatatgaatgttcttggttcccattgtgacgattatttatttctgtaaaatttgtttagaagtacgtttttgcattattcatatgcttcccagagaagctcatttagttagaaaataaggcaagttttgaagcctgctaaatgaagagacttaagaaagcttaaggtacgcttgcttgtctttaaatcttcaatatgaaggactattaattccaagattaaaagttcatatataggctaaagatgtaactaggccatttgtatttgtattcccttttatttccaaaataaaatgaaaaatctttttttaataatttcatccctatttatagtttttatattaatttgtttttcttatccaagtaaagatgtcaataggaattgcattagtccaaggcctttttcataaactgagcctcttttcaattatttcaatgggacaggaactaggatagatgtgattcctgcatttttttaccttaaatctgcctttgtttctaaaggtagatcatcttgaatatttgcttaaaattgctagtgatttcattaccaagttacttgaaaaaatgttctatatgcatttaattctgaaatcagtctaccaaggggctgctagtatatgtcagacatgaaaactattttaaagctgactttgttgccttatcttgaaaagaatctagataggtgcttttaactggggtattaacttttttagaatgacacagctgaacagtgttaataatagtgtgtcaagattgcaaagtcgacatactcatttggtttaagcaggaatcctagaagcaaatggatggggataagaataggtcattttctattcaccatcctttactattaagggaaaggaaaagaacactagctaaggaagggaaagggaagtgatatcataaaagtagcaaccttcattttacattctgtctgtttttctttttttgctttgttttgtttgtgctaatttgggaattgtgtactccgaaacaagtagaaaagtgctgtttgagggattttattaaatctttttttaatggaatgtggtacaaattgttcatgttaccaaagcaatatttccctggaatttaattcaaagtttgtggcatacaacctgagccttttcttatataagacaagaatatgttcacatcttggtatgtggccatatttatagaatgctgaactcaatgtgcaagttgtactgtatgcagttttgtaaataagtgaaaataatttgttgtactttttattcaattctgtatagattataaaattatttttattaaataaatattttacagtat

SEQ ID NO: 436735 - DNA, 950 bp, Homo sapiens
ggtttttgtcgttcacgctcacggtgttatatctctgatgtgtgtcccgtcgctgtcgcttgcgtgtagtagtggttgatgttgtcggcgtttgggtgttgtcgtttctcggtgtgttgttctggtcctggtctcgatggttgtgccgctgcccgttgctggtctggtcgctcgggtgctgctcctgctgagtctgttcttgccgtcgggctggcctgtgtaggcgtgctctcccggtgtattttggtgaggcccgggccttaggagggttcacgaaaggcccgagggcgatttttcagccccccgcacattacgcgggggggtaaccccgatgacgcccccaagttttattgttcccccgggcccgttaatattctcgtgggaggtgggggtccccacatgtggtgccccccccccgcgagtggggtcctccctcccccgcgtgtgtccccccggcgcgctttttccccccccccccgtgtgttgtattaacgccgcgcggcgcctgcctcttgcgcttttattaacgcgccctccctcttgggggccccctttgttaaaaaaaacggggtgggcggtaatgggcgcccccccggggggtgattttttggccggcgcccccctttttttttttttttttttttttttttttttttttttttttttttttttttttttaatggaatgtggtacaaattgttcatgttaccaaagcaatatttccctggaatttaattcaaagtttgtggcatacaacctgagccttttcttatataagacaagaatatgttcacatcttggtatgtggccatatttatagaatgctgaactcaatgtgcaagttgtactgtatgcagttttgtaaataagtgaaaataatttgttgtactttttattcaattctgtatagattataaaattatttttattaaataaatattttacagtat

SEQ ID NO: 436736 - DNA, 2485 bp, Homo sapiens
ggcagagggtgggccttaggacgggtctcccttaaactgggcgatcaggcagcgaccctagaggcgtctgtagggtaaagctgggggttctgtagccggaggcggcggcgagtccagaacgtcctggccttacagggagaaggcgtcactcgcggttacaagtgcctgaccctcactccagttggcggaggaggagaaggaaggggccgggccgggtcccctcccctcgcgccccggatggatgtgcccggcccggtgtctcggcgggcggcggcggcggcggccactgtgctcctgcggaccgctcgggtccgtcgcgaatgctggttcttgccgaccgcgctgctctgcgcctacggcttcttcgccagcctcaggccgtccgagcccttcctgaccccgtacctgctggggccggacaagaacctgaccgagagggaggtcttcaatgaaatttatccagtatggacttactcttacctggtgctactgtttcctgtgttccttgccacagactacctccgttataaacctgttgttctactgcaggggctcagccttattgttacatggtttatgctgctctatgcccagggactgctggccattcaatttctagaatttttttatggcatcgccacagccactgaaattgcctattactcttatatctacagtgtggtggacctgggcatgtaccagaaagtcacaagttactgtcgaagtgccactttggtgggctttacagtgggctctgtcctagggcaaatccttgtctcagtggcaggctggtcgctgttcagcctgaatgtcatctctcttacctgtgtttcagtggcttttgctgtggcctggtttttacctatgccacagaagagcctcttctttcaccacattccttctacctgccagagagtgaatggcatcaaggtacaaaatggtggcattgttactgacaccccagcttctaaccaccttcctggctgggaggacattgagtcaaaaatccctctaaatatggaggagcctcccgtggaggaaccggaacccaagccagaccgtctccttgtattgaaagtactatggaatgatttcctgatgtgctactcctctcgccctcttctctgctggtctgtgtggtgggccctctctacctgtggctattttcaagttgtgaactacacacagggcctgtgggagaaagtgatgccttctcgctatgctgctatctataatggtggcgtggaggccgtttcaaccttactgggtgctgttgctgtgtttgcagttggttatataaaaatatcctggtcaacttggggagaaatgacattatctctcttttctctcctgattgctgctgcagtgtatatcatggacactgtgggtaacatttgggtgtgctatgcatcctatgttgtcttcagaatcatctacatgttactcatcacgatagcaacgtatgtattttggctcatagaagccttaggaaaaattgtaacaggataaattttttggtttctttacaaaccatgtgcattatcagtttttctcctgaggaagcatttaggcaagttttgtttattcccatgtttgtatgttcctactgttttcagatgtttgcatgagatttatatcatttagttgcagaatgttttcatttggttggaaaggcaattgacagtagaaagaaggactcttcatgtttaaagataaatgtttacttttatttagaataaatattataagtactccagaagtaattcttatttattcactcttttatttttttttaagttttcaaattgctgcaaacctcagcatggaacgctatgccctagtatttggtgtaaataccttcattgccctggcactgcagacgctgctcactctaattgtggtagatgccagtggccttggattagaaattaccactcaggtaagatctctcctttggcatcgaaggtagtatgtgtgacttgatcagggtgacagaagtatatgtatgcttaatgcaaatccaaacaatagggaacagatgtgtttctcctgggagggtgttgggattgtcaggtcttagaacattcccgagtgtctcatcagcccaatggggctgtttcagctgagaggtaatattgattccttacagaccaagaccttctgcttcctcatccattatttccctctatacttaaatctatgcttggaatactgtatcccatgtttgagattccctgcttcatctcacaactctttaagtctcctcccttctttatttaaaacacccctcacccaaataccacggtaatgcctcgctgctgatgaacaacattatgatttgtaacttatgactattgagaaacttgcaccaacacccaacaacaatgtgaatactttttacgttcaggaattgtatagttgtatatgccttcatgcattgtgagttttaagtatatcttgttttgtactttggtaaaatgggcaa

SEQ ID NO: 436737 - DNA, 1938 bp, Homo sapiens
  misc_feature (1822)..(1822): n is a, c, g, or t
ggcagagggtgggccttaggacgggtctcccttaaactgggcgatcaggcagcgaccctagaggcgtctgtagggtaaagctgggggttctgtagccggaggcggcggcgagtccagaacgtcctggccttacagggagaaggcgtcactcgcggttacaagtgcctgaccctcactccagttggcggaggaggagaaggaaggggccgggccgggtcccctcccctcgcgccccggatggatgtgcccggcccggtgtctcggcgggcggcggcggcggcggccactgtgctcctgcggaccgctcgggtccgtcgcgaatgctggttcttgccgaccgcgctgctctgcgcctacggcttcttcgccagcctcaggccgtccgagcccttcctgaccccgtacctgctggggccggacaagaacctgaccgagagggaggtcttcaatgaaatttatccagtatggacttactcttacctggtgctactgtttcctgtgttccttgccacagactacctccgttataaacctgttgttctactgcaggggctcagccttattgttacatggtttatgctgctctatgcccagggactgctggccattcaatttctagaatttttttatggcatcgccacagccactgaaattgcctattactcttatatctacagtgtggtggacctgggcatgtaccagaaagtcacaagttactgtcgaagtgccactttggtgggctttacagtgggctctgtcctagggcaaatccttgtctcagtggcaggctggtcgctgttcagcctgaatgtcatctctcttacctgtgtttcagtggcttttgctgtggcctggtttttacctatgccacagaagagcctcttctttcaccacattccttctacctgccagagagtgaatggcatcaaggtacaaaatggtggcattgttactgacaccccagcttctaaccaccttcctggctgggaggacattgagtcaaaaatccctctaaatatggaggagcctcccgtggaggaaccggaacccaagccagaccgtctccttgtattgaaagtactatggaatgatttcctgatgtgctactcctctcgccctcttctctgctggtctgtgtggtgggccctctctacctgtggctattttcaagttgtgaactacacacagggcctgtgggagaaagtgatgccttctcgctatgctgctatctataatggtggcgtggaggccgtttcaaccttactgggtgctgttgctgtgtttgcagttggttatataaaaatatcctggtcaacttggggagaaatgacattatctctcttttctctcctgattgctgctgcagtgtatatcatggacactgtgggtaacatttgggtgtgctatgcatcctatgttgtcttcagaatcatctacatgttactcatcacgatagcaacgtatgtattttggctcatagaagccttaggaaaaattgtaacaggataaattttttggtttctttacaaaccatgtgcattatcagtttttctcctgaggaagcatttaggcaagttttgtttattcccatgtttgtatgttcctactgttttcagatgtttgcatgagatttatatcatttagttgcagaatgttttcatttggttggaaaggcaattgacagtagaaagaaggactcttcatgtttaaagataaatgtttacttttatttagaataaatattataagtactccagagtatctattatcactcttattgtctaagttcaatagtgcaactagatgacgcttgctagattgngatactcatgcctgatgaacctgtactctatggcaatgcaggctgataaatccctcagaacctcttgatcagtgttgggactgccggccagattgtctatgacatcacaagacgta

SEQ ID NO: 436738 - DNA, 524 bp, Homo sapiens
gacaaatgatctatcctttgtctctataaaagaacgtaatcactaataataagcttttctacctacagagtctctctgagaaatcaaggaaagtattccgaatatttcggcagtgggaatctctgtgctcatgctgaagatactccagcgccttcctggagatagctggaatgagagtgactttttgaaaaattaaggctgagttcctttcggtcagctgacactaagtttttcctgttctgggttaatcataaggagccccctgccatagcaaaggcagtgagtgtcaactatctgcatctggctgagagagacccgtttcctttcagggatgtggacagggtaagggcagcaagcatggttctgttaaaggagtgtggggttaacagactagaaggaagactaaggacctgaccacccatttcagcatcttcaatgtggagcagtgttctgaggactcttctatcctaggactatgacagtgtgtattaataaaatatttgctaagattctcaaaaaaagaa

SEQ ID NO: 436739 - DNA, 2647 bp, Homo sapiens
  misc_feature (211)..(211): n is a, c, g, or t
gtaacagcagcacttctgcccacaattctttgcattgttagcaaccagattttggtccctcattttagtctactgtgattaaaaggatcaggctctttggagagttgctgattccatgtcttggggcaaggacaataaatcaacttggatccagaatatcctgttgttgctagaaagcaagaatgctttcaagaatgctacagacaggccnggcgtgagccactgtgcccggcctcaaaatcaactttcacaggacgataaattagaagacacctactttgatagagatgtggagaaggcatttatgaaggctagctctgaactcttcagtcagaaaacaaaggcatctttacttgtatcaaatcaaaatggaaatatgtacacatcttcagtatatggttcccttgcatctgttctagcacagtactcacctcagcaattagcagggaagagaattggagtgttttcttatggttctggtttggctgccactctgtactctcttaaagtcacacaagatgctacaccggggtctgctcttgataaaataacagcaagtttatgtgatcttaaatcaaggcttgattcaagaactggtgtggcaccagatgtcttcgctgaaaacatgaagctcagagaggacacccatcatttggtcaactatattccccagggttcaatagattcactctttgaaggaacgtggtacttagttagggtggatgaaaagcacagaagaacttacgctcggcgtcccactccaaatgatgacactttggatgaaggagtaggacttgtgcattcaaacatagcaactgagcatattccaagccctgccaagaaagtaccaagactccctgccacagcagcagaacctgaagcagctgtcattagtaatggggaacattaagatactctgtgaggtgcaagacttcagggtggggtgggcatggggtgggggtatgggaacagttggaggaatgggatatctggggataattttaaaggattacatgttatgtaaatttttatgtgactgacatggagcctggatgactatcgtgtacttgggaaagtctctttgctctatttgctgacatgcttcctgttgtggtctggccaatgccaaatgtactcgaatgatgttaagggctctgtaaaacttcatacctctttggccatttgtatgcatgatgtttggtttttaaacatggtataatgaattgtgtacttctgtcagaagaaagcagaggtactaatctccaattaaaaaattttttaacatgtaagaattttgtactttgaacaacaagattacagaaagtacctgtggtttttggaaaacatttctagcttggggaatgtgacaacattccccagtgtggtaaaattggggtaaaatgtggtaaaatgtgatacgcacaaaccctttgaaaatagcaaaacaaacatgccctttttctaaaattgataaatcctaaagaggaagaaaagagctgggacaataaaacactggctctggaatctggaatgttaagtccaggccagcagtgacaaaagttattgtaatgacctctgaacagagaaacactgccattgaagaggcttctggtatagaaaacatggtacattcaggagctgtgaatatagctctaggtgtgctcctgaatcagttcatggtagattatgctgaacaacagtgagatgttattggaggtgtggatgagggagtttgttgttgcagtccttctttgcaccttattttaaagaataaatgaaacatttttctggttacttttttaaaaatttaaaatggaagggaagaataggggcagggcattattaggctatttctgatgcttcagtgttataaattcaacatagaggctgacaacctaaattcatggtgtaacacagctcttttccttttcctttttttttttttttttggtatctgttcaatgaaaataaggtatgacccaagtttttacctagtctgactagaagtattccacttcaaggtctgaagtaggacttttaccttaaaaaacaacaacaaacaaaactatcacacaggatagataagaagattggttaaacagttttgtgtagatctttttggtgctgaactatgacatgagccttatagattgtaaaatagggatagttggaactaatgtacagaactaaattttttaaactttatttgctgttaaattctgtgaagtttcagttatctaaaataaatatacacaaatatgaaatataatgtttcagattgcaaggtaatatgtaatagtagtgtttgtaagatactcttgtctaatattaactagtagtattttgatttgtacagtcataatttgttaaaatgacttcatttaacattcactgatgtagattaataatgtaagttctgatttaaagaatggtggcaaaatggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttgaaataaagttttagagaaatgtttcc

SEQ ID NO: 436740 - DNA, 416 bp, Homo sapiens
aaggtttaccaacagttttgccactttatattaggaaggacacgtctgccacatcccagtcagttaatggatcaccccaagcggaacaaccttcattggaatctacaagcaaagaagccttctttagcagagtggaaacattttctatatccttttttagttcatgtgaattgcactttctgcctgcttctagaattcctccaaggtattacaccacttactgtgatgctttaaacttaagaataaaaccttggtaaggaaattatatagggaaagtcaggcatcctaatatgttatcactcagaggggacagttgaggttatctaaccttttctttttacagaagaaaaaactaagagcctgaggaaaagaagaaataataactaatacttgtatatagtatgtttttgtatata

SEQ ID NO: 436741 - DNA, 562 bp, Homo sapiens
acttgtcttcatggagtacccatagggtgattaaatggaacagtaaatattcagtttcaaagtacagattgactagagcatttttttttttttttagagggaatcttgttctgttgcccaggctggagtgcaatggcgtggtctcggctcactgcaacctccacctcccaggttcaagcaattctcctgcctcagcctcccgagtagctaggattacaggcacccaccaccatgcctggctaatttttgtatttttagtagagacagtgtttcaccatgttggccaggctggtcttgaactgctgacctcgtgatccgcccacctcggcctcccaaagtgttgggattacaggcgtgagccactgtgcccggcctcaaaatcaactttcacaggacgattggacagagatttctttaaatgcctgaacaaataagtcccccagtcttgccaaggagctctgtgtgtggtggggggagcacaccttcagtagtcaagcaggcagtttgcagttctgtgttagccttcacttcctgcttgtgcagaacctcagcatcagccaga

SEQ ID NO: 436742 - DNA, 494 bp, Homo sapiens
cagtgcagtggcacaatcatagctcactgcagctttgaattcctgggcttaagcaatcctcctgcctcagcctcctgagtaactatgactacaggcgtatgccaccacatccagctaatttttttttttttggtagagatggggtctcactatattgcccaggctgatctcaaactcctggcttcaagtgatcctcctacctcagcctcccaaaatgttaggattacagtcatgagcaactgtacctggcctcaaattcatgtttcttgtctcaatctgtgtaggatgtcttcagtggggatggtggaggaagggcatctgaaaatcttctatgagagcaaaaagaacacttacaaaaattatcaaaatcaacttactttttttttttttttagagggaatcttgttctgttgcccaggctggagttgcagtgagccgtgatcgcgccattgcactgcagcctgggcgacagagcaaaaactctgtctcggaaa

SEQ ID NO: 436743 - DNA, 1768 bp, Homo sapiens
gcctcaagaggcggatattaacctcccaggacggaagttccggagccttcaaactctcggggaagcaactcggcagcggaccaagatggcggcgccctgtgagggacaagcgtttgccgtaggggttgaaaagaattggggtgcagtagttcgctccccagaagggaccccccagaaaatccggcagctgatagatgaggggattgccccggaagagggaggcgtggacgcgaaggacacgtctgccacatcccagtcagttaatggatcaccccaagcggaacaaccttcattggaatctacaagcaaagaagccttctttagcagagtggaaacattttcttctttgaaatgggcaggtaagccctttgagctgtctccactcgtctgtgcaaaatatggctgggtcacagtggaatgtgatatgctcaagtgctctagctgtcaagcttttctctgtgccagtttacaaccagcttttgactttgacagatataagcaacgatgtgctgagctgaagaaagccttgtgtactgcccatgagaagttctgtttctggccagacagcccatccccagaccgatttgggatgttgcccctggatgagcctgctattcttgttagtgaattcctagatcgttttcaaagcctttgtcacttggacctccagcttccttccctaaggccggaggacttgaaaactatgtgcttgacagaagacaagatcagtcttctcctacacttgcttgaagatgaacttgatcaccgaactgatgagagaaaaactacaatcaaattaggctcagacatccaagtccacgtcactgcctgtattctctctgtgtgtggctgggcgtgtagttcctctttggaatccatgcagctctccctgatagcatgttcgcaatgtatgaggaaggtggggctctggggcttccagcagattgaatcgtccatgactgacctggatgcatcctttggcctgaccagctccccaatcccaggccttgaggggcgaccagagcgcttacctctggtgcctgaatctcctcggaggatgatgacccggagccaggatgccactttctccccaggctcagagcaggacacatcttcccgaagcttctttgatcccacctctcagcatagagactggtgcccttgggtgaatatcacacttggcaaagaaagcagggagaatggtggaactgaaccagatgccagcgccccagcagagccaggctggaaagcagtgctgaccatcctcttggcgcacaaacagtctagccagccagctgaaacggactccatgagtctctctgagaaatcaaggaaagtattccgaatatttcggcagtgggaatctctgtgctcatgctgaagatactccagcgccttcctggagatagctggaatgagagtgactttttgaaaaattaaggctgagttcctttcggtcagctgacactaagtttttcctgttctgggttaatcataaggagccccctgccatagcaaaggcagtgagtgtcaactatctgcatctggctgagagagacccgtttcctttcagggatgtggacagggtaagggcagcaagcatggttctgttaaaggagtgtggggttaacagactagaaggaagactaaggacctgaccacccatttcagcatcttcaatgtggagcagtgttctgaggactcttctatcctaggactatgacagtgtgtattaataaaatatttgctaagattctcaaaaaaagaa

SEQ ID NO: 436744 - DNA, 1737 bp, Homo sapiens
gcctcaagaggcggatattaacctcccaggacggaagttccggagccttcaaactctcggggaagcaactcggcagcggaccaagatggcggcgccctgtgagggacaagcgtttgccgtaggggttgaaaagaattggggtgcagtagttcgctccccagaagggaccccccagaaaatccggcagctgatagatgaggggattgccccggaagagggaggcgtggacgcgaaggacacgtctgccacatcccagtcagttaatggatcaccccaagcggaacaaccttcattggaatctacaagcaaagaagccttctttagcagagtggaaacattttcttctttgaaatgggcaggtaagccctttgagctgtctccactcgtctgtgcaaaatatggctgggtcacagtggaatgtgatatgctcaagtgctctagctgtcaagcttttctctgtgccagtttacaaccagcttttgactttgacagatataagcaacgatgtgctgagctgaagaaagccttgtgtactgcccatgagaagttctgtttctggccagacagcccatccccagaccgatttgggatgttgcccctggatgagcctgctattcttgttagtgaattcctagatcgttttcaaagcctttgtcacttggacctccagcttccttccctaaggccggaggacttgaaaactatgtgcttgacagaagacaagatcagtcttctcctacacttgcttgaagatgaacttgatcaccgaactgatgagagaaaaactacaatcaaattaggctcagacatccaagtccacgtcactgcctgtattctctctgtgtgtggctgggcgtgtaggctgaaaagagccctggtcccattgtctctcgaactcggagctgggactcttccagtcctgttgaccgtcctgagccagaggctgctagccccaccaccagaactcgcccagtgacccgaagcatgggaacaggagacacccctggcctggaggtaccatctagccctctgcggaaagccaagcgagctcgcctctgctcctccagcagttcggacacatcttcccgaagcttctttgatcccacctctcagcatagagactggtgcccttgggtgaatatcacacttggcaaagaaagcagggagaatggtggaactgaaccagatgccagcgccccagcagagccaggctggaaagcagtgctgaccatcctcttggcgcacaaacagtctagccagccagctgaaacggactccatgagtctctctgagaaatcaaggaaagtattccgaatatttcggcagtgggaatctctgtgctcatgctgaagatactccagcgccttcctggagatagctggaatgagagtgactttttgaaaaattaaggctgagttcctttcggtcagctgacactaagtttttcctgttctgggttaatcataaggagccccctgccatagcaaaggcagtgagtgtcaactatctgcatctggctgagagagacccgtttcctttcagggatgtggacagggtaagggcagcaagcatggttctgttaaaggagtgtggggttaacagactagaaggaagactaaggacctgaccacccatttcagcatcttcaatgtggagcagtgttctgaggactcttctatcctaggactatgacagtgtgtattaataaaatatttgctaagattctcaaaaaaagaa

SEQ ID NO: 436745 - DNA, 1889 bp, Homo sapiens
gcctcaagaggcggatattaacctcccaggacggaagttccggagccttcaaactctcggggaagcaactcggcagcggaccaagatggcggcgccctgtgagggacaagcgtttgccgtaggggttgaaaagaattggggtgcagtagttcgctccccagaagggaccccccagaaaatccggcagctgatagatgaggggattgccccggaagagggaggcgtggacgcgaaggacacgtctgccacatcccagtcagttaatggatcaccccaagcggaacaaccttcattggaatctacaagcaaagaagccttctttagcagagtggaaacattttctatatccttttttagttcatgtgaattgcactttctgcctgcttctagaattcctccaagataagcaacgatgtgctgagctgaagaaagccttgtgtactgcccatgagaagttctgtttctggccagacagcccatccccagaccgatttgggatgttgcccctggatgagcctgctattcttgttagtgaattcctagatcgttttcaaagcctttgtcacttggacctccagcttccttccctaaggccggaggacttgaaaactatgtgcttgacagaagacaagatcagtcttctcctacacttgcttgaagatgaacttgatcaccgaactgatgagagaaaaactacaatcaaattaggctcagacatccaagtccacgtcactgcctgtattctctctgtgtgtggctgggcgtgtagttcctctttggaatccatgcagctctccctgatagcatgttcgcaatgtatgaggaaggtggggctctggggcttccagcagattgaatcgtccatgactgacctggatgcatcctttggcctgaccagctccccaatcccaggccttgaggggcgaccagagcgcttacctctggtgcctgaatctcctcggaggatgatgacccggagccaggatgccactttctccccaggctcagagcaggctgaaaagagccctggtcccattgtctctcgaactcggagctgggactcttccagtcctgttgaccgtcctgagccagaggctgctagccccaccaccagaactcgcccagtgacccgaagcatgggaacaggagacacccctggcctggaggtaccatctagccctctgcggaaagccaagcgagctcgcctctgctcctccagcagttcggacacatcttcccgaagcttctttgatcccacctctcagcatagagactggtgcccttgggtgaatatcacacttggcaaagaaagcagggagaatggtggaactgaaccagatgccagcgccccagcagagccaggctggaaagcagtgctgaccatcctcttggcgcacaaacagtctagccagccagctgaaacggactccatgagtctctctgagaaatcaaggaaagtattccgaatatttcggcagtgggaatctctgtgctcatgctgaagatactccagcgccttcctggagatagctggaatgagagtgactttttgaaaaattaaggctgagttcctttcggtcagctgacactaagtttttcctgttctgggttaatcataaggagccccctgccatagcaaaggcagtgagtgtcaactatctgcatctggctgagagagacccgtttcctttcagggatgtggacagggtaagggcagcaagcatggttctgttaaaggagtgtggggttaacagactagaaggaagactaaggacctgaccacccatttcagcatcttcaatgtggagcagtgttctgaggactcttctatcctaggactatgacagtgtgtattaataaaatatttgctaagattctcaaaaaaagaa

SEQ ID NO: 436746 - DNA, 1566 bp, Homo sapiens
ctctgctcttagaggccattcattggattttgaatctatatagtgttttttaaggtgttgctgtttatgtggatttcagataagcaacgatgtgctgagctgaagaaagccttgtgtactgcccatgagaagttctgtttctggccagacagcccatccccagaccgatttgggatgttgcccctggatgagcctgctattcttgttagtgaattcctagatcgttttcaaagcctttgtcacttggacctccagcttccttccctaaggccggaggacttgaaaactatgtgcttgacagaagacaagatcagtcttctcctacacttgcttgaagatgaacttgatcaccgaactgatgagagaaaaactacaatcaaattaggctcagacatccaagtccacgtcactgcctgtattctctctgtgtgtggctgggcgtgtagttcctctttggaatccatgcagctctccctgatagcatgttcgcaatgtatgaggaaggtggggctctggggcttccagcagattgaatcgtccatgactgacctggatgcatcctttggcctgaccagctccccaatcccaggccttgaggggcgaccagagcgcttacctctggtgcctgaatctcctcggaggatgatgacccggagccaggatgccactttctccccaggctcagagcaggctgaaaagagccctggtcccattgtctctcgaactcggagctgggactcttccagtcctgttgaccgtcctgagccagaggctgctagccccaccaccagaactcgcccagtgacccgaagcatgggaacaggagacacccctggcctggaggtaccatctagccctctgcggaaagccaagcgagctcgcctctgctcctccagcagttcggacacatcttcccgaagcttctttgatcccacctctcagcatagagactggtgcccttgggtgaatatcacacttggcaaagaaagcagggagaatggtggaactgaaccagatgccagcgccccagcagagccaggctggaaagcagtgctgaccatcctcttggcgcacaaacagtctagccagccagctgaaacggactccatgagtctctctgagaaatcaaggaaagtattccgaatatttcggcagtgggaatctctgtgctcatgctgaagatactccagcgccttcctggagatagctggaatgagagtgactttttgaaaaattaaggctgagttcctttcggtcagctgacactaagtttttcctgttctgggttaatcataaggagccccctgccatagcaaaggcagtgagtgtcaactatctgcatctggctgagagagacccgtttcctttcagggatgtggacagggtaagggcagcaagcatggttctgttaaaggagtgtggggttaacagactagaaggaagactaaggacctgaccacccatttcagcatcttcaatgtggagcagtgttctgaggactcttctatcctaggactatgacagtgtgtattaataaaatatttgctaagattctcaaaaaaagaa

SEQ ID NO: 436747 - DNA, 1110 bp, Homo sapiens
gcctcaagaggcggatattaacctcccaggacggaagttccggagccttcaaactctcggggaagcaactcggcagcggaccaagatggcggcgccctgtgagggacaagcgtttgccgtaggggttgaaaagaattggggtgcagtagttcgctccccagaagggaccccccagaaaatccggcagctgatagatgaggggattgccccggaagagggaggcgtggacgcgaaggacacgtctgccacatcccagtcagttaatggatcaccccaagcggaacaaccttcattggaatctacaagcaaagaagccttctttagcagagtggaaacattttcttctttgaaatgggcaggtaagccctttgagctgtctccactcgtctgtgcaaaatatggctgggtcacagtggaatgtgatatgctcaagtgctctagctgtcaagcttttctctgtgccagtttacaaccagcttttgactttgacagatataagcaacgatgtgctgagctgaagaaagccttgtgtactgcccatgagaagttctgtttctggccagacagcccatccccagaccgatttgggatgttgcccctggatgagcctgctattcttgttagtgaattcctagatcgttttcaaagcctttgtcacttggacctccagcttccttccctaaggccggaggacttgaaaactatgtgcttgacagaagacaagatcagtcttctcctacacttgcttgaagatgaacttgatcaccgaactgatgagagaaaaactacaatcaaattaggctcagacatccaagtccacgtcactgcctgtattctctctgtgtgtggctgggcgtgtaggtgagtcagcagattttgcctggagacatgaaccatgacaacagcattacacccatatatatcagtcactaatcgtatttagaaatcacatggtgtttcccgtgagaaaaagagacaaagaaaaactgggtgggggatggtgcgaggagaatggataataagaattagtaacaaaaccagaattggaattcaggaattcttggtgttcacaactgaactttgtttcttgtactgttgcttcttaactgg

SEQ ID NO: 436748 - DNA, 1053 bp, Homo sapiens
gcctcaagaggcggatattaacctcccaggacggaagttccggagccttcaaactctcggggaagcaactcggcagcggaccaagatggcggcgccctgtgagggacaagcgtttgccgtaggggttgaaaagaattggggtgcagtagttcgctccccagaagggaccccccagaaaatccggcagctgatagatgaggggattgccccggaagagggaggcgtggacgcgaaggacacgtctgccacatcccagtcagttaatggatcaccccaagcggaacaaccttcattggaatctacaagcaaagaagccttctttagcagagtggaaacattttcttctttgaaatgggcaggtaagccctttgagctgtctccactcgtctgtgcaaaatatggctgggtcacagtggaatgtgatatgctcaagtgctctagctgtcaagcttttctctgtgccagtttacaaccagcttttgactttgacagatataagcaacgatgtgctgagctgaagaaagccttgtgtactgcccatgagaagttctgtttctggccagacagcccatccccaggtacctggaactcaatgtgtataaaactgaactcttcatcttatacctaaaactttctccatcttggcaaatggcactgacgtcccatccagttgtcctagccagaaacctgaaagtcactttagatgctcttctctatggtcacccactttgacctatccattctacctcctacatggatcttagatataacctttcaattatatgatcccttggtttggttctttaacattcaaaggacatttgtgtggataaaagaacactcagttatttcactttatgcttaaatttattaagcaaaactaataattttgaaggtaatttttttctaacatttgccaataattataagctaaattaaatttctttaaacattttattttattttattttattttttattttgagatggagtctcactctgtcgccattgcactgcagcctgggcgacagagcaaaaactctgtctcggaaa

SEQ ID NO: 436749 - DNA, 1981 bp, Homo sapiens
gcctcaagaggcggatattaacctcccaggacggaagttccggagccttcaaactctcggggaagcaactcggcagcggaccaagatggcggcgccctgtgagggacaagcgtttgccgtaggggttgaaaagaattggggtgcagtagttcgctccccagaagggaccccccagaaaatccggcagctgatagatgaggggattgccccggaagagggaggcgtggacgcgaaggacacgtctgccacatcccagtcagttaatggatcaccccaagcggaacaaccttcattggaatctacaagcaaagaagccttctttagcagagtggaaacattttcttctttgaaatgggcaggtaagccctttgagctgtctccactcgtctgtgcaaaatatggctgggtcacagtggaatgtgatatgctcaagtgctctagctgtcaagcttttctctgtgccagtttacaaccagcttttgactttgacagatataagcaacgatgtgctgagctgaagaaagccttgtgtactgcccatgagaagttctgtttctggccagacagcccatccccagaccgatttgggatgttgcccctggatgagcctgctattcttgttagtgaattcctagatcgttttcaaagcctttgtcacttggacctccagcttccttccctaaggccggaggacttgaaaactatgtgcttgacagaagacaagatcagtcttctcctacacttgcttgaagatgaacttgatcaccgaactgatgagagaaaaactacaatcaaattaggctcagacatccaagtccacgtcactgcctgtattctctctgtgtgtggctgggcgtgtagttcctctttggaatccatgcagctctccctgatagcatgttcgcaatgtatgaggaaggtggggctctggggcttccagcagattgaatcgtccatgactgacctggatgcatcctttggcctgaccagctccccaatcccaggccttgaggggcgaccagagcgcttacctctggtgcctgaatctcctcggaggatgatgacccggagccaggatgccactttctccccaggctcagagcaggctgaaaagagccctggtcccattgtctctcgaactcggagctgggactcttccagtcctgttgaccgtcctgagccagaggctgctagccccaccaccagaactcgcccagtgacccgaagcatgggaacaggagacacccctggcctggaggtaccatctagccctctgcggaaagccaagcgagctcgcctctgctcctccagcagttcggacacatcttcccgaagcttctttgatcccacctctcagcatagagactggtgcccttgggtgaatatcacacttggcaaagaaagcagggagaatggtggaactgaaccagatgccagcgccccagcagagccaggctggaaagcagtgctgaccatcctcttggcgcacaaacagtctagccagccagctgaaacggactccatgagtctctctgagaaatcaaggaaagtattccgaatatttcggcagtgggaatctctgtgctcatgctgaagatactccagcgccttcctggagatagctggaatgagagtgactttttgaaaaattaaggctgagttcctttcggtcagctgacactaagtttttcctgttctgggttaatcataaggagccccctgccatagcaaaggcagtgagtgtcaactatctgcatctggctgagagagacccgtttcctttcagggatgtggacagggtaagggcagcaagcatggttctgttaaaggagtgtggggttaacagactagaaggaagactaaggacctgaccacccatttcagcatcttcaatgtggagcagtgttctgaggactcttctatcctaggactatgacagtgtgtattaataaaatatttgctaagattctcaaaaaaagaa

SEQ ID NO: 436750 - DNA, 2027 bp, Homo sapiens
gcctcaagaggcggatattaacctcccaggacggaagttccggagccttcaaactctcggggaagcaactcggcagcggaccaagatggcggcgccctgtgagggacaagcgtttgccgtaggggttgaaaagaattggggtgcagtagttcgctccccagaagggaccccccagaaaatccggcagctgatagatgaggggattgccccggaagagggaggcgtggacgcaaccacacccgcttgaggctctctatgaatctctgagagtcttagagaaggacacgtctgccacatcccagtcagttaatggatcaccccaagcggaacaaccttcattggaatctacaagcaaagaagccttctttagcagagtggaaacattttcttctttgaaatgggcaggtaagccctttgagctgtctccactcgtctgtgcaaaatatggctgggtcacagtggaatgtgatatgctcaagtgctctagctgtcaagcttttctctgtgccagtttacaaccagcttttgactttgacagatataagcaacgatgtgctgagctgaagaaagccttgtgtactgcccatgagaagttctgtttctggccagacagcccatccccagaccgatttgggatgttgcccctggatgagcctgctattcttgttagtgaattcctagatcgttttcaaagcctttgtcacttggacctccagcttccttccctaaggccggaggacttgaaaactatgtgcttgacagaagacaagatcagtcttctcctacacttgcttgaagatgaacttgatcaccgaactgatgagagaaaaactacaatcaaattaggctcagacatccaagtccacgtcactgcctgtattctctctgtgtgtggctgggcgtgtagttcctctttggaatccatgcagctctccctgatagcatgttcgcaatgtatgaggaaggtggggctctggggcttccagcagattgaatcgtccatgactgacctggatgcatcctttggcctgaccagctccccaatcccaggccttgaggggcgaccagagcgcttacctctggtgcctgaatctcctcggaggatgatgacccggagccaggatgccactttctccccaggctcagagcaggctgaaaagagccctggtcccattgtctctcgaactcggagctgggactcttccagtcctgttgaccgtcctgagccagaggctgctagccccaccaccagaactcgcccagtgacccgaagcatgggaacaggagacacccctggcctggaggtaccatctagccctctgcggaaagccaagcgagctcgcctctgctcctccagcagttcggacacatcttcccgaagcttctttgatcccacctctcagcatagagactggtgcccttgggtgaatatcacacttggcaaagaaagcagggagaatggtggaactgaaccagatgccagcgccccagcagagccaggctggaaagcagtgctgaccatcctcttggcgcacaaacagtctagccagccagctgaaacggactccatgagtctctctgagaaatcaaggaaagtattccgaatatttcggcagtgggaatctctgtgctcatgctgaagatactccagcgccttcctggagatagctggaatgagagtgactttttgaaaaattaaggctgagttcctttcggtcagctgacactaagtttttcctgttctgggttaatcataaggagccccctgccatagcaaaggcagtgagtgtcaactatctgcatctggctgagagagacccgtttcctttcagggatgtggacagggtaagggcagcaagcatggttctgttaaaggagtgtggggttaacagactagaaggaagactaaggacctgaccacccatttcagcatcttcaatgtggagcagtgttctgaggactcttctatcctaggactatgacagtgtgtattaataaaatatttgctaagattctcaaaaaaagaa

SEQ ID NO: 436751 - DNA, 1718 bp, Homo sapiens
gcctcaagaggcggatattaacctcccaggacggaagttccggagccttcaaactctcggggaagcaactcggcagcggaccaagatggcggcgccctgtgagggacaagcgtttgccgtaggggttgaaaagaattggggtgcagtagttcgctccccagaagggaccccccagaaaatccggcagctgatagatgaggggattgccccggaagagggaggcgtggacgcataagcaacgatgtgctgagctgaagaaagccttgtgtactgcccatgagaagttctgtttctggccagacagcccatccccagaccgatttgggatgttgcccctggatgagcctgctattcttgttagtgaattcctagatcgttttcaaagcctttgtcacttggacctccagcttccttccctaaggccggaggacttgaaaactatgtgcttgacagaagacaagatcagtcttctcctacacttgcttgaagatgaacttgatcaccgaactgatgagagaaaaactacaatcaaattaggctcagacatccaagtccacgtcactgcctgtattctctctgtgtgtggctgggcgtgtagttcctctttggaatccatgcagctctccctgatagcatgttcgcaatgtatgaggaaggtggggctctggggcttccagcagattgaatcgtccatgactgacctggatgcatcctttggcctgaccagctccccaatcccaggccttgaggggcgaccagagcgcttacctctggtgcctgaatctcctcggaggatgatgacccggagccaggatgccactttctccccaggctcagagcaggctgaaaagagccctggtcccattgtctctcgaactcggagctgggactcttccagtcctgttgaccgtcctgagccagaggctgctagccccaccaccagaactcgcccagtgacccgaagcatgggaacaggagacacccctggcctggaggtaccatctagccctctgcggaaagccaagcgagctcgcctctgctcctccagcagttcggacacatcttcccgaagcttctttgatcccacctctcagcatagagactggtgcccttgggtgaatatcacacttggcaaagaaagcagggagaatggtggaactgaaccagatgccagcgccccagcagagccaggctggaaagcagtgctgaccatcctcttggcgcacaaacagtctagccagccagctgaaacggactccatgagtctctctgagaaatcaaggaaagtattccgaatatttcggcagtgggaatctctgtgctcatgctgaagatactccagcgccttcctggagatagctggaatgagagtgactttttgaaaaattaaggctgagttcctttcggtcagctgacactaagtttttcctgttctgggttaatcataaggagccccctgccatagcaaaggcagtgagtgtcaactatctgcatctggctgagagagacccgtttcctttcagggatgtggacagggtaagggcagcaagcatggttctgttaaaggagtgtggggttaacagactagaaggaagactaaggacctgaccacccatttcagcatcttcaatgtggagcagtgttctgaggactcttctatcctaggactatgacagtgtgtattaataaaatatttgctaagattctcaaaaaaagaa

SEQ ID NO: 436752 - DNA, 2035 bp, Homo sapiens
gcctcaagaggcggatattaacctcccaggacggaagttccggagccttcaaactctcggggaagcaactcggcagcggaccaagatggcggcgccctgtgagggacaagcgtttgccgtaggggttgaaaagaattggggtgcagtagttcgctccccagaagggaccccccagaaaatccggcagctgatagatgaggggattgccccggaagagggaggcgtggacgcataagcaacgatgtgctgagctgaagaaagccttgtgtactgcccatgagaagttctgtttctggccagacagcccatccccaggtacctggaactcaatgtgtataaaactgaactcttcatcttatacctaaaactttctccatcttggcaaatggcactgacgtcccatccagttgtcctagccagaaacctgaaagtcactttagatgctcttctctatggtcacccactttgacctatccattctacctcctacatggatcttagatataacctttcaattatatgatcccttggtttggttctttaacattcaaaggacatttgtgtggataaaagaacactcagttatttcactttatgcttaaatttattaagcaaaactaataattttgaagaccgatttgggatgttgcccctggatgagcctgctattcttgttagtgaattcctagatcgttttcaaagcctttgtcacttggacctccagcttccttccctaaggccggaggacttgaaaactatgtgcttgacagaagacaagatcagtcttctcctacacttgcttgaagatgaacttgatcaccgaactgatgagagaaaaactacaatcaaattaggctcagacatccaagtccacgtcactgcctgtattctctctgtgtgtggctgggcgtgtagttcctctttggaatccatgcagctctccctgatagcatgttcgcaatgtatgaggaaggtggggctctggggcttccagcagattgaatcgtccatgactgacctggatgcatcctttggcctgaccagctccccaatcccaggccttgaggggcgaccagagcgcttacctctggtgcctgaatctcctcggaggatgatgacccggagccaggatgccactttctccccaggctcagagcaggctgaaaagagccctggtcccattgtctctcgaactcggagctgggactcttccagtcctgttgaccgtcctgagccagaggctgctagccccaccaccagaactcgcccagtgacccgaagcatgggaacaggagacacccctggcctggaggtaccatctagccctctgcggaaagccaagcgagctcgcctctgctcctccagcagttcggacacatcttcccgaagcttctttgatcccacctctcagcatagagactggtgcccttgggtgaatatcacacttggcaaagaaagcagggagaatggtggaactgaaccagatgccagcgccccagcagagccaggctggaaagcagtgctgaccatcctcttggcgcacaaacagtctagccagccagctgaaacggactccatgagtctctctgagaaatcaaggaaagtattccgaatatttcggcagtgggaatctctgtgctcatgctgaagatactccagcgccttcctggagatagctggaatgagagtgactttttgaaaaattaaggctgagttcctttcggtcagctgacactaagtttttcctgttctgggttaatcataaggagccccctgccatagcaaaggcagtgagtgtcaactatctgcatctggctgagagagacccgtttcctttcagggatgtggacagggtaagggcagcaagcatggttctgttaaaggagtgtggggttaacagactagaaggaagactaaggacctgaccacccatttcagcatcttcaatgtggagcagtgttctgaggactcttctatcctaggactatgacagtgtgtattaataaaatatttgctaagattctcaaaaaaagaa

SEQ ID NO: 436753 - DNA, 883 bp, Homo sapiens
gcctcaagaggcggatattaacctcccaggacggaagttccggagccttcaaactctcggggaagcaactcggcagcggaccaagatggcggcgccctgtgagggacaagcgtttgccgtaggggttgaaaagaattggggtgcagtagttcgctccccagaagggaccccccagaaaatccggcagctgatagatgaggggattgccccggaagagggaggcgtggacgcgaaggacacgtctgccacatcccagtcagttaatggatcaccccaagcggaacaaccttcattggaatctacaagcaaagaagccttctttagcagagtggaaacattttcttctttgaaatgggcaggtaagccctttgagctgtctccactcgtctgtgcaaaatatggctgggtcacagtggaatgtgatatgctcaagtgctctagctgtcaagcttttctctgtgccagtttacaaccagcttttgactttgacagatataagcaacgatgtgctgagctgaagaaagccttgtgtactgcccatgagaagttctgtttctggccagacagcccatccccagatggagtttcactcttgttgcccaggctggagtacagtggcgcgatcttggctcactgcaaccttcgcctcccgcgttcaagcaattctcctgcctcagcctccagagttgctaggattacaggcgtgcgccaccacgcccagctaattttgtatttttagtagagatggggtttcaccatgttggtcaatctggtctcgaactcttgacctcagatgatccgcccgtctcggcctcccaaagtgctgggattgggattacaggggtgatccactgtgcccggcctctttttctccttttctatt

SEQ ID NO: 436754 - DNA, 770 bp, Homo sapiens
gcctcaagaggcggatattaacctcccaggacggaagttccggagccttcaaactctcggggaagcaactcggcagcggaccaagatggcggcgccctgtgagggacaagcgtttgccgtaggggttgaaaagaattggggtgcagtagttcgctccccagaagggaccccccagaaaatccggcagctgatagatgaggggattgccccggaagagggaggcgtggacgcaaccacacccgcttgaggctctctatgaatctctgagagtcttagagaaggacacgtctgccacatcccagtcagttaatggatcaccccaagcggaacaaccttcattggaatctacaagcaaagaagccttctttagcagagtggaaacattttcttctttgaaatgggcaggtaagccctttgagctgtctccactcgtctgtgcaaaatatggctgggtcacagtggaatgtgatatgctcaagtgctctagctgtcaagcttttctctgtgccagtttacaaccagcttttgactttgacagatataagcaacgatgtgctgagctgaagaaagccttgtgtactgcccatgagaagttctgtttctggccagacagcccatccccagaccgatttgggatgttgcccctggatgagcctgctattcttgttagtgaattcctagatcgttttcaaagcctttgtcacttggacctccagcttccttccctaaggccggaggacttgaaaactatggtgagtttttcctgacta

SEQ ID NO: 436755 - DNA, 1547 bp, Homo sapiens
gggcttgatttaacattgtttttgtgttatttttgcttgaaacaacgcacacattttcaacaaccaaaaaatgacaatttctagtttagttaatttctacaaatcatcttatgttattagcaaggttaagacatcttttttaaaaaaattatagcttctaccaagagaaacactcaatttttctagagatttgcctctatcttcctttcctcagtcttcccagactgctatcaagctgtgtaaaaatttactttcactggaccctaaattattgtctctgctatctgactgccagtaattagtgcagaaaactaagacaggatgatacaggtttgaggggctggggagtgggaggggggagaaaaggaatgtatttaaacaatttccgatgcccatgatgagtttaaaaaccagcattgacaccatccccaaaattaaggctgtcgcttattgaatccacttgtgtccaacctcccaggattgttttatcctaatgtcacctgtatattcatttgaaaggacttggccctgttcttgggtcttcccgttacctgccccctgggtggtaagtttcctcctttctcaaccttccacgaggaggaaagaagtgtgcagtcattccacatggcctgttggaaggcctggggagggaactttgggtttgggacagatttttttttgtttttggtatcattcacagcatacgatttttactctctccatcttcaccataagacagataatttggggttgctataatgctgtcacacatctcaaagtacattcaaatcttaaaaagaaattctcgtacttttgccatgttgatactgttcagcaaacaagctaccaggaactgtgaggctttgtcatttagcattagactttaaacaagaattaaaatcatgtgctgtatttttaaaatctagccaaattaaatagtacatgagaaattcagagtattagacagttttaaggcattcaactgagaaaactttatttgtcaaagtcagaaaacattttcatcttattgagagatatgtttttaaacttttatcatcatttgtaaatgtggaagttggtggattgctgtgtttttgcatgattagcatgggagtctgttggagcaagaggaacatgcttgttttgaaaactcgagatgatgagggtggtacatgcagtgtgttctctctttattggcttctaaaccagttttgtcctttaatgcatgtcaaatatttctcccatgcttctcttagcagaaaagtttttacctataagacagggcaccttttaactctaaaactagtgatactcagtgacatagactttgtcttataaacattttttcattttttattttgaaaaattgcaaatctacagcaaaagtaaaacagtagagtgaacaccatgtaaccctcacctggtgttaacattgtaccctatttgctttaagttgtatgtatttctgaacttggcaaaattggaaattaaaatttttaaaaattacaaatatacaaagttatttatcttagcacatttaaaaaaaa

SEQ ID NO: 436756 - DNA, 2270 bp, Homo sapiens
  misc_feature (1712)..(1712): n is a, c, g, or t
ggtacaggcagcaaacaatatttaagatgctgacttgtggagcattcgggcttggaaggaaagctataggctacccattcagctcccctgtcagagactcaagctttgagaaaggctagcaaagagcaaggaaagagagaaaacaacaaagtggcgaggccctcagagtgaaagcgtaaggttcagtcagcctgctgcagctttgcagacctcagctgggcatctccagactcccctgaaggaagagccttcctcacccaaacccacaaaagatgctgaaaaagcctctctcagctgtgacctggctctgcattttcatcgtggcctttgtcagccacccagcgtggctgcagaagctctctaagcacaagacaccagcacagccacagctcaaagcggccaactgctgtgaggaggtgaaggagctcaaggcccaagttgccaaccttagcagcctgctgagtgaactgaacaagaagcaggagagggactgggtcagcgtggtcatgcaggtgatggagctggagagcaacagcaagcgcatggagtcgcggctcacagatgctgagagcaagtactccgagatgaacaaccaaattgacatcatgcagctgcaggcagcacagacggtcactcagacctccgcagatgccatctacgactgctcttccctctaccagaagaactaccgcatctctggagtgtataagcttcctcctgatgacttcctgggcagccctgaactggaggtgttctgtgacatggagacttcaggcggaggctggaccatcatccagagacgaaaaagtggccttgtctccttctaccgggactggaagcagtacaagcagggctttggcagcatccgtggggacttctggctggggaacgaacacatccaccggctctccagacagccaacccggctgcgtgtagagatggaggactgggagggcaacctgcgctacgctgagtatagccactttgttttgggcaatgaactcaacagctatcgcctcttcctggggaactacactggcaatgtggggaacgacgccctccagtatcataacaacacagccttcagcaccaaggacaaggacaatgacaactgcttggacaagtgtgcacagctccgcaaaggtggctactggtacaactgctgcacagactccaacctcaatggagtgtactaccgcctgggtgagcacaataagcacctggatggcatcacctggtatggctggcatggatctacctactccctcaaacgggtggagatgaaaatccgcccagaagacttcaagccttaaaaggaggctgccgtggagcacggatacagaaactgagacacgtggagactggatgagggcagatgaggacaggaagagagtgttagaaagggtaggactgagaaacagcctataatctccaaagaaagaataagtctccaaggagcacaaaaaaatcatatgtaccaaggatgttacagtaaacaggatgaactatttaaacccactgggtcctgccacatccttctcaaggtggtagactgagtggggtctctctgcccaagatccctgacatagcagtagcttgtcttttccacatgatttgtctgtgaaagaaaataattttgagatcgttttatctattttctctacggcttaggctatgtgagggcaaaacacaaatccctttgctaaaaaganccatattattttgattctcaaaggataggcctttgagtgttagagaaaggagtgaaggaggcaggtgggaaatggtatttctatttttaaatccagtgaaattatcttgagtctacacattatttttaaaacacaaaaattgttcggctggaactgacccaggctggacttgcggggaggaaactccagggcactgcatctggcgatcagactctgagcactgcccctgctcgccttggtcatgtacagcactgaaaggaatgaagcaccagcaggaggtggacagagtctctcatggatgccggcacaaaactgccttaaaatattcatagttaatacaggtatatctatttttatttactttgtaagaaacaagctcaaggagcttccttttaaattttgtctgtaggaaatggttgaaaactgaaggtagatggtgttatagttaataataaatgctgtaaataagcatctcactttgtaaaaataaaatattgtggttttgttttaaacattcaacgtttcttttccttctacaataaacactttcaaaatgtg

SEQ ID NO: 436757 - DNA, 2390 bp, Homo sapiens
  misc_feature (1712)..(1712): n is a, c, g, or t
ggtacaggcagcaaacaatatttaagatgctgacttgtggagcattcgggcttggaaggaaagctataggctacccattcagctcccctgtcagagactcaagctttgagaaaggctagcaaagagcaaggaaagagagaaaacaacaaagtggcgaggccctcagagtgaaagcgtaaggttcagtcagcctgctgcagctttgcagacctcagctgggcatctccagactcccctgaaggaagagccttcctcacccaaacccacaaaagatgctgaaaaagcctctctcagctgtgacctggctctgcattttcatcgtggcctttgtcagccacccagcgtggctgcagaagctctctaagcacaagacaccagcacagccacagctcaaagcggccaactgctgtgaggaggtgaaggagctcaaggcccaagttgccaaccttagcagcctgctgagtgaactgaacaagaagcaggagagggactgggtcagcgtggtcatgcaggtgatggagctggagagcaacagcaagcgcatggagtcgcggctcacagatgctgagagcaagtactccgagatgaacaaccaaattgacatcatgcagctgcaggcagcacagacggtcactcagacctccgcagatgccatctacgactgctcttccctctaccagaagaactaccgcatctctggagtgtataagcttcctcctgatgacttcctgggcagccctgaactggaggtgttctgtgacatggagacttcaggcggaggctggaccatcatccagagacgaaaaagtggccttgtctccttctaccgggactggaagcagtacaagcagggctttggcagcatccgtggggacttctggctggggaacgaacacatccaccggctctccagacagccaacccggctgcgtgtagagatggaggactgggagggcaacctgcgctacgctgagtatagccactttgttttgggcaatgaactcaacagctatcgcctcttcctggggaactacactggcaatgtggggaacgacgccctccagtatcataacaacacagccttcagcaccaaggacaaggacaatgacaactgcttggacaagtgtgcacagctccgcaaaggtggctactggtacaactgctgcacagactccaacctcaatggagtgtactaccgcctgggtgagcacaataagcacctggatggcatcacctggtatggctggcatggatctacctactccctcaaacgggtggagatgaaaatccgcccagaagacttcaagccttaaaaggaggctgccgtggagcacggatacagaaactgagacacgtggagactggatgagggcagatgaggacaggaagagagtgttagaaagggtaggactgagaaacagcctataatctccaaagaaagaataagtctccaaggagcacaaaaaaatcatatgtaccaaggatgttacagtaaacaggatgaactatttaaacccactgggtcctgccacatccttctcaaggtggtagactgagtggggtctctctgcccaagatccctgacatagcagtagcttgtcttttccacatgatttgtctgtgaaagaaaataattttgagatcgttttatctattttctctacggcttaggctatgtgagggcaaaacacaaatccctttgctaaaaaganccatattattttgattctcaaaggataggcctttgagtgttagagaaaggagtgaaggaggcaggtgggaaatggtatttctatttttaaatccagtgaaattatcttgagtctacacattatttttaaaacacaaaaattgttcggctggaactgacccaggctggacttgcggggaggaaactccagggcactgcatctggcgatcagactctgagcactgcccctgctcgccttggtcatgtacagcactgaaaggaatgaagcaccagcaggaggtggacagagtctctcatggatgccggcacaaaactgccttaaaatattcatagttaatacaggtatatctatttttatttactttgtaagaaacaagctcaaggagcttccttttaaattttgtctgtaggaaatggttgaaaactgaaggtagatggtgttatagttaataataaatgctgtaaataagcatctcactttgtaaaaataaaatattgtggttttgttttaaacattcaacgtttcttttccttctacaataaacactttcaaaatgtgagtatcttctttttaaattcttaccatcaccacttacagcaggataaaaagttaaagttaaatcagagggtgagcagtgacagaggcccggggtttgttttggtgttcagggcaaccaag

SEQ ID NO: 436758 - DNA, 356 bp, Homo sapiens
ctcacacatagtaagtgttcagtaagtaggaactgttgttattctcatcatcattatttaatggaattgtagataaaaagtatacatcaggccagcatggtaaccgaggcaggtggatagcttgaggccaggagtttgagacagcctgggcaacatagcaagacctcatctctacaaagaaaattttttttaaattagcaaggcatggtggcacacacctgtattcccagctactcaagaggctgaggaaggaggatcacttgagcccaggtgtttgaggctgcagtgagctatgatcatgccactatactccagcctgagcaacagagcaaggccctgtctctgtttaaaaaaaa

SEQ ID NO: 436759 - DNA, 1030 bp, Homo sapiens
  misc_feature (69)..(69): n is a, c, g, or t
  misc_feature (172)..(172): n is a, c, g, or t
  misc_feature (190)..(190): n is a, c, g, or t
  misc_feature (207)..(208): n is a, c, g, or t
  misc_feature (250)..(250): n is a, c, g, or t
  misc_feature (270)..(270): n is a, c, g, or t
  misc_feature (294)..(294): n is a, c, g, or t
  misc_feature (347)..(347): n is a, c, g, or t
  misc_feature (358)..(358): n is a, c, g, or t
  misc_feature (373)..(373): n is a, c, g, or t
  misc_feature (385)..(385): n is a, c, g, or t
  misc_feature (410)..(410): n is a, c, g, or t
  misc_feature (489)..(489): n is a, c, g, or t
tatttgtcacgcgtttaatctatcgtcaggttgaggcattgcctttacaagccacctccgctctggtcncggtaatatgttcccgtaagggccctcgcctctgggttgcctacagttcacgtcacgaccctcgcctctgggtcaggtataatgttccagtcacgggccatcncctctgggttcgcgtacnggttcacatcacagacnntcgcctcttgggtcgggtgataatggttcacgtcagcggccntcagctcttgggtatgcgtnacggttcaacgtcacgacccctcngctctttgagtcggaaggtggttccatctcagccgccctctgcctcttgggtntgcgtggtttntctgcctcagcctcntgagtagctaanggaggtgtcttgagattatcatcgnctaagggtgaaagcggccccgcagacgctcggcaaggtgtcttgatattatcatctgctgagggtggagctgagggtgnaaggggagtgagctgacgctcggaaggtgtcttgagattatcatccgctgagggtgaaagctcgtgccgaattcggcacgaggaacagtgtgaggagcgaatagaagaggtcaccaaaaaggggaatgaagctgtagcttccagagacctgagtgaaaacaacgaccagagacagcagcatctagctggtgcgctggcacccctggcctcacacagactcccgagtagctgggactacaggcacacagtcactgaagcaggccctgtttgcaattcacgttgccacctccaacttaaacattcttcatatgtgatgtccttagtcactaaggttaaactttcccacccagaaaaggcaacttagataaaatcttagagtactttcatactcttctaagtcctcttccagcctcactttgagtcctccttggggttgataggaattttctcttgctttctcaataaagtctctattcatctcatgtttaatttgtacgcatagaattgctgagaaataaaatgttctgttcaacttaaaaaa

SEQ ID NO: 436760 - DNA, 2970 bp, Homo sapiens
gggggcggggccttgccgctgcggaggccggagacgcggcggcgctggacgcggaggcgctgggcgcacggcgcggagccggccggagctcgaggccggcggcggcgggagagcgacccgggcggcctcgtagcggggccccggatccccgagtggcggccggagcctcgaaaagagattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaagagacaagttgagaaagaggaaaccaatgagatccaggtggtgaatgaggagcctcagagctgccctgtcagtgagccaggaaaatccagagatggagggccctgagcgagaccagcttgtcatccccgacggacaggaggaggagcaggaagctgccggggaagggagaaaccagcagaaactgagaggagaagatgactacaacatggatgaaaatgaagcagaatctgagacagacaagcaagcagccctggcagggaatgacagaaacatagatgtttttaatgttgaagatcagaaaagagacaccataaatttacttgatcagcgtgaaaagcggaatcatacactctgaattgaactggaatcacatatttcacaacagggccgaagagatgactataaaatgttcatgagggactgaatactgaaaactgtgaaatgtactaaataaaatgtacatctgaagatgattattgtgaaattttagtatgcactttgtgtaggaaaaaatggaatggtcttttaaacagcttttggggggtactttggaagtgtctaataaggtgtcacaatttttggtagtaggtatttcgtgagaagttcaacaccaaaactggaacatagttctccttcaagtgttggcgacagcggggcttcctgattctggaatataactttgtgtaaattaacagccacctatagaagagtccatctgctgtgaaggagagacagagaactctgggttccgtcgtcctgtccacgtgctgtaccaagtgctggtgccagcctgttacctgttctcactgaaaagtctggctaatgctcttgtgtagtcacttctgattctgacaatcaatcaatcaatggcctagagcactgactgttaacacaaacgtcactagcaaagtagcaacagctttaagtctaaatacaaagctgttctgtgtgagaattttttaaaaggctacttgtataataacccttgtcatttttaatgtacaaaacgctattaagtggcttagaatttgaacatttgtggtctttatttactttgcttcgtgtgtgggcaaagcaacatcttccctaaatatatattaccaagaaaagcaagaagcagattaggtttttgacaaaacaaacaggccaaaagggggctgacctggagcagagcatggtgagaggcaaggcatgagagggcaagtttgttgtggacagatctgtgcctactttattactggagtaaaagaaaacaaagttcattgatgtcgaaggatatatacagtgttagaaattaggactgtttagaaaaacaggaatacaatggttgtttttatcatagtgtacacatttagcttgtggtaaatgactcacaaaactgattttaaaatcaagttaatgtgaattttgaaaattactacttaatcctaattcacaataacaatggcattaaggtttgacttgagttggttcttagtattatttatggtaaataggctcttaccacttgcaaataactggccacatcattaatgactgacttcccagtaaggctctctaaggggtaagtaggaggatccacaggatttgagatgctaaggccccagagatcgtttgatccaaccctcttattttcagaggggaaaatggggcctagaagttacagagcatctagctggtgcgctggcacccctggcctcacacagactcccgagtagctgggactacaggcacacagtcactgaagcaggccctgtttgcaattcacgttgccacctccaacttaaacattcttcatatgtgatgtccttagtcactaaggttaaactttcccacccagaaaaggcaacttagataaaatcttagagtactttcatactcttctaagtcctcttccagcctcactttgagtcctccttggggttgataggaattttctcttgctttctcaataaagtctctattcatctcatgtttaatttgtacgcatagaattgctgagaaataaaatgttctgttcaacttaaaaaa

SEQ ID NO: 436761 - DNA, 3132 bp, Homo sapiens
gggggcggggccttgccgctgcggaggccggagacgcggcggcgctggacgcggaggcgctgggcgcacggcgcggagccggccggagctcgaggccggcggcggcgggagagcgacccgggcggcctcgtagcggggccccggatccccgagtggcggccggagcctcgaaaagagattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaagagacaagttgagaaagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtcagtgagccaggaaaatccagagatggagggccctgagcgagaccagcttgtcatccccgacggacaggaggaggagcaggaagctgccggggaagggagaaaccagcagaaactgagaggagaagatgactacaacatggatgaaaatgaagcagaatctgagacagacaagcaagcagccctggcagggaatgacagaaacatagatgtttttaatgttgaagatcagaaaagagacaccataaatttacttgatcagcgtgaaaagcggaatcatacactctgaattgaactggaatcacatatttcacaacagggccgaagagatgactataaaatgttcatgagggactgaatactgaaaactgtgaaatgtactaaataaaatgtacatctgaagatgattattgtgaaattttagtatgcactttgtgtaggaaaaaatggaatggtcttttaaacagcttttggggggtactttggaagtgtctaataaggtgtcacaatttttggtagtaggtatttcgtgagaagttcaacaccaaaactggaacatagttctccttcaagtgttggcgacagcggggcttcctgattctggaatataactttgtgtaaattaacagccacctatagaagagtccatctgctgtgaaggagagacagagaactctgggttccgtcgtcctgtccacgtgctgtaccaagtgctggtgccagcctgttacctgttctcactgaaaagtctggctaatgctcttgtgtagtcacttctgattctgacaatcaatcaatcaatggcctagagcactgactgttaacacaaacgtcactagcaaagtagcaacagctttaagtctaaatacaaagctgttctgtgtgagaattttttaaaaggctacttgtataataacccttgtcatttttaatgtacaaaacgctattaagtggcttagaatttgaacatttgtggtctttatttactttgcttcgtgtgtgggcaaagcaacatcttccctaaatatatattaccaagaaaagcaagaagcagattaggtttttgacaaaacaaacaggccaaaagggggctgacctggagcagagcatggtgagaggcaaggcatgagagggcaagtttgttgtggacagatctgtgcctactttattactggagtaaaagaaaacaaagttcattgatgtcgaaggatatatacagtgttagaaattaggactgtttagaaaaacaggaatacaatggttgtttttatcatagtgtacacatttagcttgtggtaaatgactcacaaaactgattttaaaatcaagttaatgtgaattttgaaaattactacttaatcctaattcacaataacaatggcattaaggtttgacttgagttggttcttagtattatttatggtaaataggctcttaccacttgcaaataactggccacatcattaatgactgacttcccagtaaggctctctaaggggtaagtaggaggatccacaggatttgagatgctaaggccccagagatcgtttgatccaaccctcttattttcagaggggaaaatggggcctagaagttacagagcatctagctggtgcgctggcacccctggcctcacacagactcccgagtagctgggactacaggcacacagtcactgaagcaggccctgtttgcaattcacgttgccacctccaacttaaacattcttcatatgtgatgtccttagtcactaaggttaaactttcccacccagaaaaggcaacttagataaaatcttagagtactttcatactcttctaagtcctcttccagcctcactttgagtcctccttggggttgataggaattttctcttgctttctcaataaagtctctattcatctcatgtttaatttgtacgcatagaattgctgagaaataaaatgttctgttcaacttaaaaaaaacatcctgcaaactaactcatctaacaacctccacacaacacacaagagcg

SEQ ID NO: 436762 - DNA, 3026 bp, Homo sapiens
gggggcggggccttgccgctgcggaggccggagacgcggcggcgctggacgcggaggcgctgggcgcacggcgcggagccggccggagctcgaggccggcggcggcgggagagcgacccgggcggcctcgtagcggggccccggatccccgagtggcggccggagcctcgaaaagagattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaagagacaagttgagaaagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtcagtgagccaggaaaatccagagatggagggccctgagcgagaccagcttgtcatccccgacggacaggaggaggagcaggaagctgccggggaagggagaaaccagcagaaactgagaggagaagatgactacaacatggatgaaaatgaagcagaatctgagacagacaagcaagcagccctggcagggaatgacagaaacatagatgtttttaatgttgaagatcagaaaagagacaccataaatttacttgatcagcgtgaaaagcggaatcatacactctgaattgaactggaatcacatatttcacaacagggccgaagagatgactataaaatgttcatgagggactgaatactgaaaactgtgaaatgtactaaataaaatgtacatctgaagatgattattgtgaaattttagtatgcactttgtgtaggaaaaaatggaatggtcttttaaacagcttttggggggtactttggaagtgtctaataaggtgtcacaatttttggtagtaggtatttcgtgagaagttcaacaccaaaactggaacatagttctccttcaagtgttggcgacagcggggcttcctgattctggaatataactttgtgtaaattaacagccacctatagaagagtccatctgctgtgaaggagagacagagaactctgggttccgtcgtcctgtccacgtgctgtaccaagtgctggtgccagcctgttacctgttctcactgaaaagtctggctaatgctcttgtgtagtcacttctgattctgacaatcaatcaatcaatggcctagagcactgactgttaacacaaacgtcactagcaaagtagcaacagctttaagtctaaatacaaagctgttctgtgtgagaattttttaaaaggctacttgtataataacccttgtcatttttaatgtacaaaacgctattaagtggcttagaatttgaacatttgtggtctttatttactttgcttcgtgtgtgggcaaagcaacatcttccctaaatatatattaccaagaaaagcaagaagcagattaggtttttgacaaaacaaacaggccaaaagggggctgacctggagcagagcatggtgagaggcaaggcatgagagggcaagtttgttgtggacagatctgtgcctactttattactggagtaaaagaaaacaaagttcattgatgtcgaaggatatatacagtgttagaaattaggactgtttagaaaaacaggaatacaatggttgtttttatcatagtgtacacatttagcttgtggtaaatgactcacaaaactgattttaaaatcaagttaatgtgaattttgagttggttcttagtattatttatggtaaataggctcttaccacttgcaaataactggccacatcattaatgactgacttcccagtaaggctctctaaggggtaagtaggaggatccacaggatttgagatgctaaggccccagagatcgtttgatccaaccctcttattttcagaggggaaaatggggcctagaagttacagagcatctagctggtgcgctggcacccctggcctcacacagactcccgagtagctgggactacaggcacacagtcactgaagcaggccctgtttgcaattcacgttgccacctccaacttaaacattcttcatatgtgatgtccttagtcactaaggttaaactttcccacccagaaaaggcaacttagataaaatcttagagtactttcatactcttctaagtcctcttccagcctcactttgagtcctccttggggttgataggaattttctcttgctttctcaataaagtctctattcatctcatgtttaatttgtacgcatagaattgctgagaaataaaatgttctgttcaacttaaaaaa

SEQ ID NO: 436763 - DNA, 1789 bp, Homo sapiens
  misc_feature (28)..(28): n is a, c, g, or t
  misc_feature (35)..(35): n is a, c, g, or t
  misc_feature (37)..(37): n is a, c, g, or t
ggcgggacgccgggccggcaagtaggtntttggcngngttcggttttaatgcgagttcagaaaacaccataaatttacttgatcagcgtgaaaagcggaatcatacactctgaattgaactggaatcacatatttcacaacagggccgaagagatgactataaaatgttcatgagggactgaatactgaaaactgtgaaatgtactaaataaaatgtacatctgaagatgattattgtgaaattttagtatgcactttgtgtaggaaaaaatggaatggtcttttaaacagcttttggggggtactttggaagtgtctaataaggtgtcacaatttttggtagtaggtatttcgtgagaagttcaacaccaaaactggaacatagttctccttcaagtgttggcgacagcggggcttcctgattctggaatataactttgtgtaaattaacagccacctatagaagagtccatctgctgtgaaggagagacagagaactctgggttccgtcgtcctgtccacgtgctgtaccaagtgctggtgccagcctgttacctgttctcactgaaaagtctggctaatgctcttgtgtagtcacttctgattctgacaatcaatcaatcaatggcctagagcactgactgttaacacaaacgtcactagcaaagtagcaacagctttaagtctaaatacaaagctgttctgtgtgagaattttttaaaaggctacttgtataataacccttgtcatttttaatgtacaaaacgctattaagtggcttagaatttgaacatttgtggtctttatttactttgcttcgtgtgtgggcaaagcaacatcttccctaaatatatattaccaagaaaagcaagaagcagattaggtttttgacaaaacaaacaggccaaaagggggctgacctggagcagagcatggtgagaggcaaggcatgagagggcaagtttgttgtggacagatctgtgcctactttattactggagtaaaagaaaacaaagttcattgatgtcgaaggatatatacagtgttagaaattaggactgtttagaaaaacaggaatacaatggttgtttttatcatagtgtacacatttagcttgtggtaaatgactcacaaaactgattttaaaatcaagttaatgtgaattttgaaaattactacttaatcctaattcacaataacaatggcattaaggtttgacttgagttggttcttagtattatttatggtaaataggctcttaccacttgcaaataactggccacatcattaatgactgacttcccagtaaggctctctaaggggtaagtaggaggatccacaggatttgagatgctaaggccccagagatcgtttgatccaaccctcttattttcagaggggaaaatggggcctagaagttacagagcatctagctggtgcgctggcacccctggcctcacacagactcccgagtagctgggactacaggcacacagtcactgaagcaggccctgtttgcaattcacgttgccacctccaacttaaacattcttcatatgtgatgtccttagtcactaaggttaaactttcccacccagaaaaggcaacttagataaaatcttagagtactttcatactcttctaagtcctcttccagcctcactttgagtcctccttggggttgataggaattttctcttgctttctcaataaagtctctattcatctcatgtttaatttgtacgcatagaattgctgagaaataaaatgttctgttcaacttaaaaaa

SEQ ID NO: 436764 - DNA, 2279 bp, Homo sapiens
gggggcggggccttgccgctgcggaggccggagacgcggcggcgctggacgcggaggcgctgggcgcacggcgcggagccggccggagctcgaggccggcggcggcgggagagcgacccgggcggcctcgtagcggggccccggatccccgagtggcggccggagcctcgaaaagagattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaagagacaagttgagaaagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtcagtgagccaggaaaatccagagatggagggccctgagcgagaccagcttgtcatccccgacggacaggaggaggagcaggaagctgccggggaagggagaaaccagcagaaactgagaggagaagatgactacaacatggatgaaaatgaagcagaatctgagacagacaagcaagcagccctggcagggaatgacagaaacatagatgatcttccctaaatatatattaccaagaaaagcaagaagcagattaggtttttgacaaaacaaacaggccaaaagggggctgacctggagcagagcatggtgagaggcaaggcatgagagggcaagtttgttgtggacagatctgtgcctactttattactggagtaaaagaaaacaaagttcattgatgtcgaaggatatatacagtgttagaaattaggactgtttagaaaaacaggaatacaatggttgtttttatcatagtgtacacatttagcttgtggtaaatgactcacaaaactgattttaaaatcaagttaatgtgaattttgaaaattactacttaatcctaattcacaataacaatggcattaaggtttgacttgagttggttcttagtattatttatggtaaataggctcttaccacttgcaaataactggccacatcattaatgactgacttcccagtaaggctctctaaggggtaagtaggaggatccacaggatttgagatgctaaggccccagagatcgtttgatccaaccctcttattttcagaggggaaaatggggcctagaagttacagagcatctagctggtgcgctggcacccctggcctcacacagactcccgagtagctgggactacaggcacacagtcactgaagcaggccctgtttgcaattcacgttgccacctccaacttaaacattcttcatatgtgatgtccttagtcactaaggttaaactttcccacccagaaaaggcaacttagataaaatcttagagtactttcatactcttctaagtcctcttccagcctcactttgagtcctccttggggttgataggaattttctcttgctttctcaataaagtctctattcatctcatgtttaatttgtacgcatagaattgctgagaaataaaatgttctgttcaacttaaaaaa

SEQ ID NO: 436765 - DNA, 2654 bp, Homo sapiens
gggggcggggccttgccgctgcggaggccggagacgcggcggcgctggacgcggaggcgctgggcgcacggcgcggagccggccggagctcgaggccggcggcggcgggagagcgacccgggcggcctcgtagcggggccccggatccccgagtggcggccggagcctcgaaaagagattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaagagacaagttgagaaagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtcagtgagccaggaaaatccagagatggagggccctgagcgagaccagcttgtcatccccgacggacaggaggaggagcaggaagctgccggggaagggagaaaccagcagaaactgagaggagaagatgactacaacatggatgaaaatgaagcagaatctgagacagacaagcaagcagccctggcagggaatgacagaaacatagatgtttttaatgttgaagatcagaaaagagacaccataaatttacttgatcagcgtgaaaagcggaatcatacactctgaattgaactggaatcacatatttcacaacagggccgaagagatgactataaaatgttcatgagggactgaatactgaaaactgtgaaatgtactaaataaaatgtacatctgaagatgattattgtgaaattttagtatgcactttgtgtaggaaaaaatggaatggtcttttaaacagcttttggggggtactttggaagtgtctaataaggtgtcacaatttttggtagtaggtatttcgtgagaagttcaacaccaaaactggaacatagttctccttcaagtgttggcgacagcggggcttcctgattctggaatataactttgtgtaaattaacagccacccacctccaacttaaacattcttcatatgtgatgtccttagtcactaaggttaaactttcccacccagaaaaggcaacttagataaaatcttagagtactttcatactcttctaagtcctcttccagcctcactttgagtcctccttggggttgataggaattttctcttgctttctcaataaagtctctattcatctcatgtttaatttgtacgcatagaattgctgagaaataaaatgttctgttcaacttaaaaaacttgtcacagctctgtttttttgcttttccccttcatcctctattagatccttaaagaatccaccctcaaactgtggactaaggatggcagtttgccttaaaccttctgtggaatgagatgggctgtcaggacgtcttcaacccacagtaccccgaaagctttgtgctcaccacgtgtgcactctgcatgctttctccaggctgccctagggatcacgacagattcagccaacaatggagagggctgtgggctgttccaacaaaatagaacagtcacctctggtgacacgcatctgtagtcctagcctcccaagtagctgggactacagatgcatgtcaccatgcccggctaattttttgtatttttagtagaaatggggtttcactttgttagccaggatggtctcaatctcctgatttcgtgatcagtgtaaagactcagagagctgttgcataataacttcatgtgagtctccaaaatttgatactaaaggcttggtggtctcagggggccaatgtggctgcagcctgaggggccaaatggagagggcagaaacgaagtaggagaggcagaaggggtcaaactggcattctgggtaaagactaggtcattcattagagaacagtggattttaagtagagttgtc

SEQ ID NO: 436766 - DNA, 1380 bp, Homo sapiens
gggggcggggccttgccgctgcggaggccggagacgcggcggcgctggacgcggaggcgctgggcgcacggcgcggagccggccggagctcgaggccggcggcggcgggagagcgacccgggcggcctcgtagcggggccccggatccccgagtggcggccggagcctcgaaaagagattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaagagacaagttgagaaagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtcagtgagccaggaaaatccagagatggagggccctgagcgagaccagcttgtcatccccgacggacaggaggaggagcaggaagctgccggggaagggagaaaccagcagaaactgagaggagaagatgactacaacatggatgaaaatgaagcagaatctgagacagacaagcaagcagccctggcagggaatgacagaaacatagatggatcttgggaagtgccactgaagactgggaaaatccttcacgtggcattcgat

SEQ ID NO: 436767 - DNA, 1243 bp, Homo sapiens
gggggcggggccttgccgctgcggaggccggagacgcggcggcgctggacgcggaggcgctgggcgcacggcgcggagccggccggagctcgaggccggcggcggcgggagagcgacccgggcggcctcgtagcggggccccggatccccgagtggcggccggagcctcgaaaagagattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaagagacaagttgagaaagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtcagtgagccaggaaaatccagagatggagggccctgagcgagaccagcttgtcatccccgacggacaggaggaggagcaggaagctgccggggaaggtgggtgtgaagtttcgggggccgctgtgg

SEQ ID NO: 436768 - DNA, 1196 bp, Homo sapiens
gggggcggggccttgccgctgcggaggccggagacgcggcggcgctggacgcggaggcgctgggcgcacggcgcggagccggccggagctcgaggccggcggcggcgggagagcgacccgggcggcctcgtagcggggccccggatccccgagtggcggccggagcctcgaaaagagattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaccacctccaacttaaacattcttcatatgtgatgtccttagtcactaaggttaaactttcccacccagaaaaggcaacttagataaaatcttagagtactttcatactcttctaagtcctcttccagcctcactttgagtcctccttggggttgataggaattttctcttgctttctcaataaagtctctattcatctcatgtttaatttgtacgcatagaattgctgagaaataaaatgttctgttcaacttaaaaaa

SEQ ID NO: 436769 - DNA, 3080 bp, Homo sapiens
gggggcggggccttgccgctgcggaggccggagacgcggcggcgctggacgcggaggcgctgggcgcacggcgcggagccggccggagctcgaggccggcggcggcgggagagcgacccgggcggcctcgtagcggggccccggatccccgagtggcggccggagcctcgaaaagagattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaagagacaagttgagaaagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtcagtgagccaggaaaatccagagatggagggccctgagcgagaccagcttgtcatccccgacggacaggaggaggagcaggaagctgccggggaagggagaaaccagcagaaactgagaggagaagatgactacaacatggatgaaaatgaagcagaatctgagacagacaagcaagcagccctggcagggaatgacagaaacatagatgtttttaatgttgaagatcagaaaagagacaccataaatttacttgatcagcgtgaaaagcggaatcatacactctgaattgaactggaatcacatatttcacaacagggccgaagagatgactataaaatgttcatgagggactgaatactgaaaactgtgaaatgtactaaataaaatgtacatctgaagatgattattgtgaaattttagtatgcactttgtgtaggaaaaaatggaatggtcttttaaacagcttttggggggtactttggaagtgtctaataaggtgtcacaatttttggtagtaggtatttcgtgagaagttcaacaccaaaactggaacatagttctccttcaagtgttggcgacagcggggcttcctgattctggaatataactttgtgtaaattaacagccacctatagaagagtccatctgctgtgaaggagagacagagaactctgggttccgtcgtcctgtccacgtgctgtaccaagtgctggtgccagcctgttacctgttctcactgaaaagtctggctaatgctcttgtgtagtcacttctgattctgacaatcaatcaatcaatggcctagagcactgactgttaacacaaacgtcactagcaaagtagcaacagctttaagtctaaatacaaagctgttctgtgtgagaattttttaaaaggctacttgtataataacccttgtcatttttaatgtacaaaacgctattaagtggcttagaatttgaacatttgtggtctttatttactttgcttcgtgtgtgggcaaagcaacatcttccctaaatatatattaccaagaaaagcaagaagcagattaggtttttgacaaaacaaacaggccaaaagggggctgacctggagcagagcatggtgagaggcaaggcatgagagggcaagtttgttgtggacagatctgtgcctactttattactggagtaaaagaaaacaaagttcattgatgtcgaaggatatatacagtgttagaaattaggactgtttagaaaaacaggaatacaatggttgtttttatcatagtgtacacatttagcttgtggtaaatgactcacaaaactgattttaaaatcaagttaatgtgaattttgaaaattactacttaatcctaattcacaataacaatggcattaaggtttgacttgagttggttcttagtattatttatggtaaataggctcttaccacttgcaaataactggccacatcattaatgactgacttcccagtaaggctctctaaggggtaagtaggaggatccacaggatttgagatgctaaggccccagagatcgtttgatccaaccctcttattttcagaggggaaaatggggcctagaagttacagagcatctagctggtgcgctggcacccctggcctcacacagactcccgagtagctgggactacaggcacacagtcactgaagcaggccctgtttgcaattcacgttgccacctccaacttaaacattcttcatatgtgatgtccttagtcactaaggttaaactttcccacccagaaaaggcaacttagataaaatcttagagtactttcatactcttctaagtcctcttccagcctcactttgagtcctccttggggttgataggaattttctcttgctttctcaataaagtctctattcatctcatgtttaatttgtacgcatagaattgctgagaaataaaatgttctgttcaacttaaaaaa

SEQ ID NO: 436770 - DNA, 3028 bp, Homo sapiens
atcttcactttttccgttgctagcagtggaagggtcacagaccaaacactaaggcctgagcggtgacaaccgaggcgagatgatggtcaacagggaatgcctcgtgggagaaaaaagacaattttattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaagagacaagttgagaaagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtcagtgagccaggaaaatccagagatggagggccctgagcgagaccagcttgtcatccccgacggacaggaggaggagcaggaagctgccggggaagggagaaaccagcagaaactgagaggagaagatgactacaacatggatgaaaatgaagcagaatctgagacagacaagcaagcagccctggcagggaatgacagaaacatagatgtttttaatgttgaagatcagaaaagagacaccataaatttacttgatcagcgtgaaaagcggaatcatacactctgaattgaactggaatcacatatttcacaacagggccgaagagatgactataaaatgttcatgagggactgaatactgaaaactgtgaaatgtactaaataaaatgtacatctgaagatgattattgtgaaattttagtatgcactttgtgtaggaaaaaatggaatggtcttttaaacagcttttggggggtactttggaagtgtctaataaggtgtcacaatttttggtagtaggtatttcgtgagaagttcaacaccaaaactggaacatagttctccttcaagtgttggcgacagcggggcttcctgattctggaatataactttgtgtaaattaacagccacctatagaagagtccatctgctgtgaaggagagacagagaactctgggttccgtcgtcctgtccacgtgctgtaccaagtgctggtgccagcctgttacctgttctcactgaaaagtctggctaatgctcttgtgtagtcacttctgattctgacaatcaatcaatcaatggcctagagcactgactgttaacacaaacgtcactagcaaagtagcaacagctttaagtctaaatacaaagctgttctgtgtgagaattttttaaaaggctacttgtataataacccttgtcatttttaatgtacaaaacgctattaagtggcttagaatttgaacatttgtggtctttatttactttgcttcgtgtgtgggcaaagcaacatcttccctaaatatatattaccaagaaaagcaagaagcagattaggtttttgacaaaacaaacaggccaaaagggggctgacctggagcagagcatggtgagaggcaaggcatgagagggcaagtttgttgtggacagatctgtgcctactttattactggagtaaaagaaaacaaagttcattgatgtcgaaggatatatacagtgttagaaattaggactgtttagaaaaacaggaatacaatggttgtttttatcatagtgtacacatttagcttgtggtaaatgactcacaaaactgattttaaaatcaagttaatgtgaattttgaaaattactacttaatcctaattcacaataacaatggcattaaggtttgacttgagttggttcttagtattatttatggtaaataggctcttaccacttgcaaataactggccacatcattaatgactgacttcccagtaaggctctctaaggggtaagtaggaggatccacaggatttgagatgctaaggccccagagatcgtttgatccaaccctcttattttcagaggggaaaatggggcctagaagttacagagcatctagctggtgcgctggcacccctggcctcacacagactcccgagtagctgggactacaggcacacagtcactgaagcaggccctgtttgcaattcacgttgccacctccaacttaaacattcttcatatgtgatgtccttagtcactaaggttaaactttcccacccagaaaaggcaacttagataaaatcttagagtactttcatactcttctaagtcctcttccagcctcactttgagtcctccttggggttgataggaattttctcttgctttctcaataaagtctctattcatctcatgtttaatttgtacgcatagaattgctgagaaataaaatgttctgttcaacttaaaaaa

SEQ ID NO: 436771 - DNA, 2193 bp, Homo sapiens
ttttttttttttttttttttttaaatcaaatgctggcaaggtcacagctaactgtgttctgtgcacagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtcagtgagccaggaaaatccagagatggagggccctgagcgagaccagcttgtcatccccgacggacaggaggaggagcaggaagctgccggggaagggagaaaccagcagaaactgagaggagaagatgactacaacatggatgaaaatgaagcagaatctgagacagacaagcaagcagccctggcagggaatgacagaaacatagatgtttttaatgttgaagatcagaaaagagacaccataaatttacttgatcagcgtgaaaagcggaatcatacactctgaattgaactggaatcacatatttcacaacagggccgaagagatgactataaaatgttcatgagggactgaatactgaaaactgtgaaatgtactaaataaaatgtacatctgaagatgattattgtgaaattttagtatgcactttgtgtaggaaaaaatggaatggtcttttaaacagcttttggggggtactttggaagtgtctaataaggtgtcacaatttttggtagtaggtatttcgtgagaagttcaacaccaaaactggaacatagttctccttcaagtgttggcgacagcggggcttcctgattctggaatataactttgtgtaaattaacagccacctatagaagagtccatctgctgtgaaggagagacagagaactctgggttccgtcgtcctgtccacgtgctgtaccaagtgctggtgccagcctgttacctgttctcactgaaaagtctggctaatgctcttgtgtagtcacttctgattctgacaatcaatcaatcaatggcctagagcactgactgttaacacaaacgtcactagcaaagtagcaacagctttaagtctaaatacaaagctgttctgtgtgagaattttttaaaaggctacttgtataataacccttgtcatttttaatgtacaaaacgctattaagtggcttagaatttgaacatttgtggtctttatttactttgcttcgtgtgtgggcaaagcaacatcttccctaaatatatattaccaagaaaagcaagaagcagattaggtttttgacaaaacaaacaggccaaaagggggctgacctggagcagagcatggtgagaggcaaggcatgagagggcaagtttgttgtggacagatctgtgcctactttattactggagtaaaagaaaacaaagttcattgatgtcgaaggatatatacagtgttagaaattaggactgtttagaaaaacaggaatacaatggttgtttttatcatagtgtacacatttagcttgtggtaaatgactcacaaaactgattttaaaatcaagttaatgtgaattttgaaaattactacttaatcctaattcacaataacaatggcattaaggtttgacttgagttggttcttagtattatttatggtaaataggctcttaccacttgcaaataactggccacatcattaatgactgacttcccagtaaggctctctaaggggtaagtaggaggatccacaggatttgagatgctaaggccccagagatcgtttgatccaaccctcttattttcagaggggaaaatggggcctagaagttacagagcatctagctggtgcgctggcacccctggcctcacacagactcccgagtagctgggactacaggcacacagtcactgaagcaggccctgtttgcaattcacgttgccacctccaacttaaacattcttcatatgtgatgtccttagtcactaaggttaaactttcccacccagaaaaggcaacttagataaaatcttagagtactttcatactcttctaagtcctcttccagcctcactttgagtcctccttggggttgataggaattttctcttgctttctcaataaagtctctattcatctcatgtttaatttgtacgcatagaattgctgagaaataaaatgttctgttcaacttaaaaaa

SEQ ID NO: 436772 - DNA, 3727 bp, Homo sapiens
gggggcggggccttgccgctgcggaggccggagacgcggcggcgctggacgcggaggcgctgggcgcacggcgcggagccggccggagctcgaggccggcggcggcgggagagcgacccgggcggcctcgtagcggggccccggatccccgagtggcggccggagcctcgaaaagagattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaagagacaagttgagaaagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtcagtgagccaggaaaatccagagatggagggccctgagcgagaccagcttgtcatccccgacggacaggaggaggagcaggaagctgccggggaagggagaaaccagcagaaactgagaggagaagatgactacaacatggatgaaaatgaagcagaatctgagacagacaagcaagcagccctggcagggaatgacagaaacatagatgtttttaatgttgaagatcagaaaagagacaccataaatttacttgatcagcgtgaaaagcggaatcatacactctgaattgaactggaatcacatatttcacaacagggccgaagagatgactataaaatgttcatgagggactgaatactgaaaactgtgaaatgtactaaataaaatgtacatctgaagatgattattgtgaaattttagtatgcactttgtgtaggaaaaaatggaatggtcttttaaacagcttttggggggtactttggaagtgtctaataaggtgtcacaatttttggtagtaggtatttcgtgagaagttcaacaccaaaactggaacatagttctccttcaagtgttggcgacagcggggcttcctgattctggaatataactttgtgtaaattaacagccacctatagaagagtccatctgctgtgaaggagagacagagaactctgggttccgtcgtcctgtccacgtgctgtaccaagtgctggtgccagcctgttacctgttctcactgaaaagtctggctaatgctcttgtgtagtcacttctgattctgacaatcaatcaatcaatggcctagagcactgactgttaacacaaacgtcactagcaaagtagcaacagctttaagtctaaatacaaagctgttctgtgtgagaattttttaaaaggctacttgtataataacccttgtcatttttaatgtacaaaacgctattaagtggcttagaatttgaacatttgtggtctttatttactttgcttcgtgtgtgggcaaagcaacatcttccctaaatatatattaccaagaaaagcaagaagcagattaggtttttgacaaaacaaacaggccaaaagggggctgacctggagcagagcatggtgagaggcaaggcatgagagggcaagtttgttgtggacagatctgtgcctactttattactggagtaaaagaaaacaaagttcattgatgtcgaaggatatatacagtgttagaaattaggactgtttagaaaaacaggaatacaatggttgtttttatcatagtgtacacatttagcttgtggtaaatgactcacaaaactgattttaaaatcaagttaatgtgaattttgaaaattactacttaatcctaattcacaataacaatggcattaaggtttgacttgagttggttcttagtattatttatggtaaataggctcttaccacttgcaaataactggccacatcattaatgactgacttcccagtaaggctctctaaggggtaagtaggaggatccacaggatttgagatgctaaggccccagagatcgtttgatccaaccctcttattttcagaggggaaaatggggcctagaagttacagagcatctagctggtgcgctggcacccctggcctcacacagactcccgagtagctgggactacaggcacacagtcactgaagcaggccctgtttgcaattcacgttgccacctccaacttaaacattcttcatatgtgatgtccttagtcactaaggttaaactttcccacccagaaaaggcaacttagataaaatcttagagtactttcatactcttctaagtcctcttccagcctcactttgagtcctccttggggttgataggaattttctcttgctttctcaataaagtctctattcatctcatgtttaatttgtacgcatagaattgctgagaaataaaatgttctgttcaacttaaaaaacttgtcacagctctgtttttttgcttttccccttcatcctctattagatccttaaagaatccaccctcaaactgtggactaaggatggcagtttgccttaaaccttctgtggaatgagatgggctgtcaggacgtcttcaacccacagtaccccgaaagctttgtgctcaccacgtgtgcactctgcatgctttctccaggctgccctagggatcacgacagattcagccaacaatggagagggctgtgggctgttccaacaaaatagaacagtcacctctggtgacacgcatctgtagtcctagcctcccaagtagctgggactacagatgcatgtcaccatgcccggctaattttttgtatttttagtagaaatggggtttcactttgttagccaggatggtctcaatctcctgatttcgtgatcagtgtaaagactcagagagctgttgcataataacttcatgtgagtctccaaaatttgatactaaaggcttggtggtctcagggggccaatgtggctgcagcctgaggggccaaatggagagggcagaaacgaagtaggagaggcagaaggggtcaaactggcattctgggtaaagactaggtcattcattagagaacagtggattttaagtagagttgtc

SEQ ID NO: 436773 - DNA, 2007 bp, Homo sapiens
gggggcggggccttgccgctgcggaggccggagacgcggcggcgctggacgcggaggcgctgggcgcacggcgcggagccggccggagctcgaggccggcggcggcgggagagcgacccgggcggcctcgtagcggggccccggatccccgagtggcggccggagcctcgaaaagagattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaagagacaagttgagaaagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtcagtgagccaggaaaatccagagatggagggccctgagcgagaccagcttgtcatccccgacggacaggaggaggagcaggaagctgccggggaagggagaaaccagcagaaactgagaggagaagatgactacaacatggatgaaaatgaagcagaatctgagacagacaagcaagcagccctggcagggaatgacagaaacatagatgtttttaatgttgaagatcagaaaagagacaccataaatttacttgatcagcgtgaaaagcggaatcatacactctgaattgaactggaatcacatatttcacaacagggccgaagagatgactataaaatgttcatgagggactgaatactgaaaactgtgaaatgtactaaataaaatgtacatctgaagatgattattgtgaaattttagtatgcactttgtgtaggaaaaaatggaatggtcttttaaacagcttttggggggtactttggaagtgtctaataaggtgtcacaatttttggtagtaggtatttcgtgagaagttcaacaccaaaactggaacatagttctccttcaagtgttggcgacagcggggcttcctgattctggaatataactttgtgtaaattaacagccacccacctccaacttaaacattcttcatatgtgatgtccttagtcactaaggttaaactttcccacccagaaaaggcaacttagataaaatcttagagtactttcatactcttctaagtcctcttccagcctcactttgagtcctccttggggttgataggaattttctcttgctttctcaataaagtctctattcatctcatgtttaatttgtacgcatagaattgctgagaaataaaatgttctgttcaacttaaaaaa

SEQ ID NO: 436774 - DNA, 1650 bp, Homo sapiens
gggggcggggccttgccgctgcggaggccggagacgcggcggcgctggacgcggaggcgctgggcgcacggcgcggagccggccggagctcgaggccggcggcggcgggagagcgacccgggcggcctcgtagcggggccccggatccccgagtggcggccggagcctcgaaaagagattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaagagacaagttgagaaagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtcagtgagccaggaaaatccagagatggagggccctgagcgagaccagcttgtcatccccgacggacaggaggaggagcaggaagctgccggggaagggagaaaccagcagaaactgagaggagaagatgactacaacatggatgaaaatgaagcagaatctgagacagacaagcaagcagccctggcagggaatgacagaaacatagatggacacatgagtgaaggggacaactaagatgcagccttttcttctcaaatatcaggtttattttgtccgcaagtgaaagggaagaactactctgccgaagatcatcttttatcaactccaaagctcctgaagtgaatcctcagcaccacggtttgaaacagttatgctcccagtgatcaccttggtcatgatttcttccaagaagacagacctcattccaatttgatgtttaactgtcaagtacatccacagctagtgccaccaaattcagggcaaaatgtgttaatttttctccataggagcaaataaatgatcttcaattaa

SEQ ID NO: 436775 - DNA, 1375 bp, Homo sapiens
gggggcggggccttgccgctgcggaggccggagacgcggcggcgctggacgcggaggcgctgggcgcacggcgcggagccggccggagctcgaggccggcggcggcgggagagcgacccgggcggcctcgtagcggggccccggatccccgagtggcggccggagcctcgaaaagagattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaagagacaagttgagaaagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtcagtgagccaggaaaatccagagatggagggccctgagcgagaccagcttgtcatccccgacggacaggaggaggagcaggaagctgccggggaagggacgggaggaaagatgaggcagaggtgaaagcacatggaacacaacaggggggactggctaaccttggcacaaaagcagcacagcaggcccggggaaagggtgggggcaggaagcagccggcctccctctgaccctccctgtcgccttggcagggcgctga

SEQ ID NO: 436776 - DNA, 676 bp, Homo sapiens
ggggaaaaatgctaatacaagtataaaaccaaattgctatttatgaaggtaaagtttggtgctgcctcactgtcaactctttccttatactctaactatagtcttgataaagtactcaatattccctctacatggaatagtctatttgcccagtacacaaacacaaacacaaactaatacacacatacatgcacacaccattgccttccttctagctaatttctacatatcttttaagtcttagcttatatgttatttcttccaggaaacttactgaaacatccccaagaccatattaggtgccctctctaattccctgaacaataacaatatgggtcactctgtacagtaattacctgttcatccgtttgctttgttcgttaaactctaagttccttttggcagggaatagctttgccttcattattgtttcattcttaggatttagcataatttctgccataaagtatataggtgcttgatataaatctgttaaaggaacgtatacattttgcaatacagaaagcaatttttttcatcattattccaatgtgtgttcttttccaaaatatattttctagagtaaaacgagttctaattatttcaaagagcagttaatttggatatgcagatattattgcttgcccactgtggtaacctttagggctgcttgcaa

SEQ ID NO: 436777 - DNA, 2941 bp, Homo sapiens
atgccggctgagctgctgctgctgctgattgttgccttcgccagccccagctgccaggtgctctcatcactgcgcatggctgcaatcctggatgatcagacagtgtgtggccgcggtgagcgtctggccttggccttggcccgggagcagatcaacgggatcatcgaggtcccagccaaggcccgagtggaagtagacatctttgagctgcagcgggacagccagtacgagaccacggacaccatgtgtcagatcttacccaaaggggttgtgtctgtccttgggccctcctctagcccagcatctgcctccaccgtgagccatatctgtggagagaaggagatcccccacatcaaggtgggtcccgaggagacaccccgccttcagtaccttcgcttcgcgtctgtcagcctgtaccccagtaacgaggacgtcagcttggcggtctcccgaatcctcaagtccttcaactacccctcggccagcctcatctgcgccaaggctgagtgcctgctgcgattggaggaactggtgcgtggcttcctcatctccaaggagacgctgtcagtgaggatgttggacgacagccgggaccccacaccactgctcaaggagatccgtgatgacaaggtgtccaccatcatcatcgacgccaacgcctccatctcccacctcatcctccgtaaggcctcggaactgggaatgacctcagcgttttacaagtacatcctcaccaccatggacttccccatcctgcatctggacggtattgtggaggactcctccaacatcctgggcttctccatgttcaacacgtcccaccccttctaccctgagtttgtccgcagcctcaacatgtcctggagggagaactgtgaagccagcacctacctgggccctgcgctgtcagccgccctgatgtttgacgccgtgcacgtggtggtgagcgctgtccgagagctgaaccgcagccaggagatcggtgtgaagcctctggcctgtacatcggccaacatttggccccacgggaccagcctcatgaactacctgcgcatggtagagtatgatgggctgaccgggcgggtcgagttcaacagcaaagggcagagaaccaactacaccctgcgcatcctagaaaagtcccggcagggccaccgtgagattggggtgtggtactctaaccgcaccctggccatgaatgccaccaccctggacatcaacctgtcgcagacactggccaacaagaccctggtggtcacaaccatcctggagaacccatacgtcatgcgccggcccaacttccaggccctgtcggggaacgaacgcttcgagggcttctgcgtggacatgctgcgggagctggccgagctgctgcgcttccgctaccgcctgcggttggtggaggatgggctgtacggggcgcccgagcccaacggctcctggacgggcatggttggcgagctcatcaaccggaaggcagacctggctgtggccgccttcaccatcacagctgagcgggagaaggtcatcgacttttccaagccctttatgaccctggggatcagcatcctctaccgagtgcacatgggccgcaagcctggctacttctccttcctggaccccttctcccctgctgtgtggctcttcatgcttcttgcctacctggctgtcagctgcgtcctgtttctggctgccaggctgagccctatgagtggtataacccacacccatgcctgcgggcacgcccccacatcctggagaaccagtacacgctgggcaacagcctgtggtttcccgtggggggcttcatgcagcagggctcggagatcatgccccgggcgctgtccacgcgctgtgtcagcggagtctggtgggccttcaccttgatcatcatctcctcctacacggccaacctggccccttcctcaccgtgcagcgcatggaggtgcctgtggagtcggccgatgacctggcagatcagaccaacatcgagtatggcaccatccacgccggctccaccatgaccttcttccagaattcacggtaccaaacgtaccagcgcatgtggaactacatgcagtcgaagcagcccagcgtgttcgtcaagagcacagaagagggcattgcccgcgtcctcaactcccgctacgccttcctgctcgagtccaccatgaacgaataccaccggcgcctcaactgcaacctcacccagatcgggggactcctcgacaccaagggctacggcattggcatgccgctgggctccccgttccgggatgagatcacactggccatcctgcagcttcaggagaacaaccggctggagatcctgaagcgcaagtggtgggaggggggccggtgccccaaggaggaggaccatcgagctaaaggtttgggcatggagaacattggtggcatttttatcgtgctcatctgtggcctcatcattgctgtcttcgtggcggtcatggaattcatatggtccacacggaggtcagctgagtccgaggaggtgtcggtgtgccaggagatgctgcaggagctgcgccacgccgtttcttgccgcaagacgtcgcgttcccgccggcgccgacgcccgggcggcccgagccgggccctgctgtcactgcgcgcggtccgcgagatgcgcctcagcaacggcaagctctactcggccggcgcgggcggggatgcgggcagcgcgcacgggggcccgcagcgcctcctggacgacccggggccccccagcggagcccgacccgccgcccccaccccctgcacccacgtgcgcgtctgccaggagtgccggcgcatccaggcgctgcgggcctcgggggccggcgcgcctccgcgtggcctgggcgtccccgccgaagccaccagcccgccccggccgcggcctggccccgccggcccccgggagctggcggagcacgagtga

SEQ ID NO: 436778 - DNA, 3148 bp, Homo sapiens
  misc_feature (1)..(1): n is a, c, g, or t
nggcattttggcttttaaaatcatttatgtactgatgacacctgtattagttatctattactgcatagcaaattgccccagatcttagcagctttgtaggtgagtcggtgccagggaggcagtgtagcttggtgcttggaggacaggctcaggagtcacaccgacctggattcaaatcccagttccggctggccactgtggtttatgcctatgattccagtgctttgggaggccaagccggaaggatcacttgaacctaagagttttgagaccagcttgggcaatatagcaagaccctgtctttacaaaaaattaaaaaattagccaggtgtggtatgcacctgtagtctcagctacaggctgaagtaggaggatcgcttgagcccaggaagtggaggtggcagtgaacaatgatcatgccactgtatgccagcctgggtaaccaagtgagattctgtcaaaagaaaggaagaaatctcagtttcctccctgactcagtgcacagtcttaagcaagtgtatcactttcgtcattcagaaacacttgcctcaggtgggatacctgtcccacaggatcatcataagacctgaataaacccagggtctggcacacagttggtgcctggtagatattaatcactttcatctgcccgtgtctctggttctgtggtagttggtcgggaagtatcttagtcaatgaagaaataagtatagaatagggtgtgtggggtgttgaagcccaaggatggcttaagggcaggatgtgaggttggggaggagaggtggtccagggagaggtgtggatggggattcgtctggtgtccaactgcatgccaagtcccgcactggatgcagacgaaagatgataaacacatagccatataatacagtgttaggtggtgacagctgctccaaagtaaattaaagggaagacactgacagggagtggggcgcttggtgccattttaaataaagtcatcagaatagactccctggggagccagcatgtgggcagagacctggatgaagtgcggagagggacattccaggcagaggcaaaggtcctaagacaggactgtgtgtgatgaatttggggagcagccaggaggctgatgaggctggagctgagagccgtgggggtgagggtgtctgagagtggccgaggggaggagcttgcaacaggaagccatggagagtcctgagcacaggaaaggtatggcctctgactcttcctaacactgtctctctggctgctgtgttgagaggagactgggctgggggtgaggagaggctgcagggaagaccctgggcacgtggtagaggcgggggaaggccgtggtgagggcacagtttggggtttggggcggtcagggctgcagggcccgatggctggtccagcccctcgtgtgcctgcccaggctccccgttccgggatgagatcacactggccatcctgcagcttcaggagaacaaccggctggagatcctgaagcgcaagtggtgggaggggggccggtgccccaaggaggaggaccatcgagctaaaggtcagttcccgcgtatggtgtccccttcccatagccccctcccagcccccttcccacacagccccaactccctttgccccccaactcccttcgccctccaggtttgggcatggagaacattggtggcatttttatcgtgctcatctgtggcctcatcattgctgtcttcgtggcggtcatggaattcatatggtccacacggaggtcagctgagtccgaggaggtgaggaggctgggggtgggggtgggcaggaacagggacccccaggggctgaggtgcgtgaagattgtggcattgggagccatacctggagggtggtggggatcgcgagaagggggcagaggaatgcaggaggtggggaagtaagagagctgatggggccagagaatcagcgcgtgaggaagaacaggagggaaagtaggcacagggagcaatgaggatgcagggagaggaggtgagggacaggatgtggggagccacagaggcagaaaagcaagaagaaataagaagagaaacagggccaagtgcagtggctcacacctgtaatcccagcactttgggaggccgaggctggcggatcacctgaggtcaggagttcaagatcagcctggccaacatggtgaaaccccatctctactaaaaatacaaaaattagccgggcatggtggtgcacacctgtaatcccagctactcgggaggctgagatgggaggatcgcttgaacccgggaggtggagattgcagtaagctgagattgcaccactgcactccagcctgggtgacagagggaaccagaagaggacacagccctggactggtcccacactgtgttcaggagggctgcttccatgtccctgggggccgcccagccacacccctgcatttccagacccattcgtgctcttgcacccctggactgctggttccctgcttcccctctctctgtcagcctccagcccttcctccccctcctcacatccagcggctgaccttacatctactccccagaccccagctctgcatccagctgcctgccagtgttctgcacttggcccaaggactcctctgaaggagccgtccatgctgctagtaaaggtgccctccacccgtgtccaggttgccttctcaaggacatccctccggcaagtctgtcctttcctcctgcagcatcagttgtcctctctttattggattcaggccaccaacgtacaaatatgctgtcatttctccagtcttaaaccctctcctgacctcactttccctcccagccaccgcccactttcttcccttctctttacagccttggcagcagtggggggtctccctgatgcttccagtttcttctttcctcccatttcctcttgccccccactccagtctggcatcggtccctgccactccactgaagccactcttgtcaccagcaacttccatgtctgaaattcccggtctcaggcctcatgtatatgaggtagcagtgggcttcggcacagccagtcactctcaatcctcaaagccccttcttccccttctcccacttctccggtcactccttcccaggctccctcgttgggtttctctttctccccaggctctgtttgt

SEQ ID NO: 436779 - DNA, 655 bp, Homo sapiens
agctccgtgggaggctgaggtgggagaattgcttgggtccaggaggttgaggctgcagtgagctgtgttcacgcctctccaccctagagcaggaccctgtctcaaaaacaaaaccaaaccactaaatgcttcgtaaggaaatttgaaagtgaggaatatatcttttctatttacccacaaatctaccatttgaagagggtgcccttcaccccttctggtacatccacgtttctatctggtgttgtgtttcttttacctgcagaacttcctttaatatttcttgctgtgcgggtctgctggcaattaattctcccagctttggttttgtatgaaaaatgtgttagtgtgtcttctttgagggatatttttgcctgctgtggaattctaggttgacagtttgttttgatttttctttcagcatgttgcatcatctttgggcttgcacactctctgacaagaagtcgactggcactgttatctttgattctctgaatgtaatatgtttccccccttctagctgcttttaagatgtttctctttattgctggttttcagcaattgattataatgtgtcttggtgcgttttataaatatgtgtgtttagcctacctggggtttatggagcttacatctgcaagtttatggttttcatcaa

SEQ ID NO: 436780 - DNA, 450 bp, Homo sapiens
gaccgcccgcgccacccccaggtgtcggtgtgccaggagatgctgcaggagctgcgccacgccgtttcttgccgcaagacgtcgcgttcccgccggcgccgacgcccgggcggcccgagccgggccctgctgtcactgcgcgcggtccgcgagatgcgcctcagcaacggcaagctctactcggccggcgcgggcggggatgcgggcagcgcgcacgggggcccgcagcgcctcctggacgacccggggccccccagcggagcccgacccgccgcccccaccccctgcacccacgtgcgcgtctgccaggagtgccggcgcatccaggcgctgcgggcctcgggggccggcgcgcctccgcgtggcctgggcgtccccgccgaagccaccagcccgccccggccgcggcctggccccgccggcccccgggagctggcggagcacgagtga

SEQ ID NO: 436781 - DNA, 2356 bp, Homo sapiens
agtcatcttcatagctgactctagaggatacacggagggccagcgcaccgtaccatcatcatcgacgccaacgcctccatctcccacctcatcctccgtaaggcctcggaactgggaatgacctcagcgttttacaagtacatcctcaccaccatggacttccccatcctgcatctggacggtattgtggaggactcctccaacatcctgggcttctccatgttcaacacgtcccaccccttctaccctgagtttgtccgcagcctcaacatgtcctggagggagaactgtgaagccagcacctacctgggccctgcgctgtcagccgccctgatgtttgacgccgtgcacgtggtggtgagcgctgtccgagagctgaaccgcagccaggagatcggtgtgaagcctctggcctgtacatcggccaacatttggccccacgggaccagcctcatgaactacctgcgcatggtagagtatgatgggctgaccgggcgggtcgagttcaacagcaaagggcagagaaccaactacaccctgcgcatcctagaaaagtcccggcagggccaccgtgagattggggtgtggtactctaaccgcaccctggccatgaatgccaccaccctggacatcaacctgtcgcagacactggccaacaagaccctggtggtcacaaccatcctggagaacccatacgtcatgcgccggcccaacttccaggccctgtcggggaacgaacgcttcgagggcttctgcgtggacatgctgcgggagctggccgagctgctgcgcttccgctaccgcctgcggttggtggaggatgggctgtacggggcgcccgagcccaacggctcctggacgggcatggttggcgagctcatcaaccggaaggcagacctggctgtggccgccttcaccatcacagctgagcgggagaaggtcatcgacttttccaagccctttatgaccctggggatcagcatcctctaccgagtgcacatgggccgcaagcctggctacttctccttcctggaccccttctcccctgctgtgtggctcttcatgcttcttgcctacctggctgtcagctgcgtcctgtttctggctgccaggctgagccctatgagtggtataacccacacccatgcctgcgggcacgcccccacatcctggagaaccagtacacgctgggcaacagcctgtggtttcccgtggggggcttcatgcagcagggctcggagatcatgccccgggcgctgtccacgcgctgtgtcagcggagtctggtgggccttcaccttgatcatcatctcctcctacacggccaacctggccccttcctcaccgtgcagcgcatggaggtgcctgtggagtcggccgatgacctggcagatcagaccaacatcgagtatggcaccatccacgccggctccaccatgaccttcttccagaattcacggtaccaaacgtaccagcgcatgtggaactacatgcagtcgaagcagcccagcgtgttcgtcaagagcacagaagagggcattgcccgcgtcctcaactcccgctacgccttcctgctcgagtccaccatgaacgaataccaccggcgcctcaactgcaacctcacccagatcgggggactcctcgacaccaagggctacggcattggcatgccgctgggctccccgttccgggatgagatcacactggccatcctgcagcttcaggagaacaaccggctggagatcctgaagcgcaagtggtgggaggggggccggtgccccaaggaggaggaccatcgagctaaaggtttgggcatggagaacattggtggcatttttatcgtgctcatctgtggcctcatcattgctgtcttcgtggcggtcatggaattcatatggtccacacggaggtcagctgagtccgaggaggtgtcggtgtgccaggagatgctgcaggagctgcgccacgccgtttcttgccgcaagacgtcgcgttcccgccggcgccgacgcccgggcggcccgagccgggccctgctgtcactgcgcgcggtccgcgagatgcgcctcagcaacggcaagctctactcggccggcgcgggcggggatgcgggcagcgcgcacgggggcccgcagcgcctcctggacgacccggggccccccagcggagcccgacccgccgcccccaccccctgcacccacgtgcgcgtctgccaggagtgccggcgcatccaggcgctgcgggcctcgggggccggcgcgcctccgcgtggcctgggcgtccccgccgaagccaccagcccgccccggccgcggcctggccccgccggcccccgggagctggcggagcacgagtga

SEQ ID NO: 436782 - DNA, 327 bp, Homo sapiens
cacagctagctatccaggcaccctctgagagatacatggccacatacattctgggagacctactcccaccaagacatgggaagcacacacaccttccccgctgtcaattccacttcccaagaaagacaccagagccacttcctcactcctgacccacccagtttcccattcctggggagagggaagttatttgagggtttgagggtggcagctcaggggcctttggggctcctctgcctaggcagcctcttatccatcccacccccgcctctgtcccaccgcagctgtcagccgccctgatgtttgacgccgtgcacgtggtggtga

SEQ ID NO: 436783 - DNA, 2097 bp, Homo sapiens
  misc_feature (1)..(1): n is a, c, g, or t
nggcattttggcttttaaaatcatttatgtactgatgacacctgtattagttatctattactgcatagcaaattgccccagatcttagcagctttgtaggtgagtcggtgccagggaggcagtgtagcttggtgcttggaggacaggctcaggagtcacaccgacctggattcaaatcccagttccggctggccactgtggtttatgcctatgattccagtgctttgggaggccaagccggaaggatcacttgaacctaagagttttgagaccagcttgggcaatatagcaagaccctgtctttacaaaaaattaaaaaattagccaggtgtggtatgcacctgtagtctcagctacaggctgaagtaggaggatcgcttgagcccaggaagtggaggtggcagtgaacaatgatcatgccactgtatgccagcctgggtaaccaagtgagattctgtcaaaagaaaggaagaaatctcagtttcctccctgactcagtgcacagtcttaagcaagtgtatcactttcgtcattcagaaacacttgcctcaggtgggatacctgtcccacaggatcatcataagacctgaataaacccagggtctggcacacagttggtgcctggtagatattaatcactttcatctgcccgtgtctctggttctgtggtagttggtcgggaagtatcttagtcaatgaagaaataagtatagaatagggtgtgtggggtgttgaagcccaaggatggcttaagggcaggatgtgaggttggggaggagaggtggtccagggagaggtgtggatggggattcgtctggtgtccaactgcatgccaagtcccgcactggatgcagacgaaagatgataaacacatagccatataatacagtgttaggtggtgacagctgctccaaagtaaattaaagggaagacactgacagggagtggggcgcttggtgccattttaaataaagtcatcagaatagactccctggggagccagcatgtgggcagagacctggatgaagtgcggagagggacattccaggcagaggcaaaggtcctaagacaggactgtgtgtgatgaatttggggagcagccaggaggctgatgaggctggagctgagagccgtgggggtgagggtgtctgagagtggccgaggggaggagcttgcaacaggaagccatggagagtcctgagcacaggaaaggtatggcctctgactcttcctaacactgtctctctggctgctgtgttgagaggagactgggctgggggtgaggagaggctgcagggaagaccctgggcacgtggtagaggcgggggaaggccgtggtgagggcacagtttggggtttggggcggtcagggctgcagggcccgatggctggtccagcccctcgtgtgcctgcccaggctccccgttccgggatgagatcacactggccatcctgcagcttcaggagaacaaccggctggagatcctgaagcgcaagtggtgggaggggggccggtgccccaaggaggaggaccatcgagctaaaggtttgggcatggagaacattggtggcatttttatcgtgctcatctgtggcctcatcattgctgtcttcgtggcggtcatggaattcatatggtccacacggaggtcagctgagtccgaggaggtgtcggtgtgccaggagatgctgcaggagctgcgccacgccgtttcttgccgcaagacgtcgcgttcccgccggcgccgacgcccgggcggcccgagccgggccctgctgtcactgcgcgcggtccgcgagatgcgcctcagcaacggcaagctctactcggccggcgcgggcggggatgcgggcagcgcgcacgggggcccgcagcgcctcctggacgacccggggccccccagcggagcccgacccgccgcccccaccccctgcacccacgtgcgcgtctgccaggagtgccggcgcatccaggcgctgcgggcctcgggggccggcgcgcctccgcgtggcctgggcgtccccgccgaagccaccagcccgccccggccgcggcctggccccgccggcccccgggagctggcggagcacgagtga

SEQ ID NO: 436784 - DNA, 1176 bp, Homo sapiens
agtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgagtcctttggtgttctaggaccccaggttaaggaaccaaaaaagacagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaa

SEQ ID NO: 436785 - DNA, 1131 bp, Homo sapiens
agtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaa

SEQ ID NO: 436786 - DNA, 1190 bp, Homo sapiens
agtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaa

SEQ ID NO: 436787 - DNA, 897 bp, Homo sapiens
agtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaa

SEQ ID NO: 436788 - DNA, 1245 bp, Homo sapiens
agtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaa

SEQ ID NO: 436789 - DNA, 918 bp, Homo sapiens
agtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaaggtgagtagtgccatataatattaggtattaactgttgggtggccaagaacaattattctctcaactgagatgagatccctcaacccaaacatctcagtcctgggaatgatttccataaaaatgtacacatcaataaacagaaactcatgcttagggatgtctgttgcatcattattcagagtagcaaggaaattgggatcaaaatcaatgcctttgagtaggtaagtgacagaatgaacaatggtagccatactgtgaatatta

SEQ ID NO: 436790 - DNA, 1121 bp, Homo sapiens
agtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcgagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcgtcttcctctgcctgcagtacagactgagaggaaaacttcgagcagagatagagaatctccaccggacttttgatccccactttctgtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaa

SEQ ID NO: 436791 - DNA, 664 bp, Homo sapiens
  misc_feature (269)..(269): n is a, c, g, or t
gacgcgagaggatggtagcggagcgcacccacaaagcggcagccaccggtgcccgcggccctggggagttgggcgcgcccgggacggtggctctggtggcggcgcgggcggagcgcggcgcacggctgccgagtccagggtcgtgcgggctgctgacgctggccctctgctcgctggcactcagcctgctcgcccactttcggacggccgagctgcaggcccgggtgctgcgcctggaagcggagcgcggggagcagcaaatggagacngctattttgggacgagtcaatcaactgctggacgagaaatggaagctccactcaaggaggcgccgggaggccccaaagacatctccaggatgtaactgcccaccagggcctttgcacttgctgtgctggtgtgcagtgaccatcccttggactccctcgtgccgcctcttcattatctaggtttcgactccaacaccacctcctcagaaaggccttcctcagtcatccaagctaaagcattttcccaaattccagccccgtctactatatttgcatattgtaacttctcatagcagtcatcagtgtgtaaatttttcccatttatttatttctgtttgttgtctatcacctgcggctagagataataataataataagccaatacttgtatggtg

SEQ ID NO: 436792 - DNA, 2904 bp, Homo sapiens
atctcatacgcacgtgtacagacgccacgtggattgacgccacgtgtacagacgccacgtggacagacgccacgttgagggtgcgtcagggaaatcatgcagccatcaggacacaggctccgggacgtcgagcatcatcctctcctggctgaaaatgacaactatgactcttcatcgtcctcctcctccgaggctgacgtggctgaccgggtctggttcatccgtgacggctgcggcatgatctgtgctgtcatgacgtggcttctggtcgcctatgcagacttcgtggtgactttcgtcatgctgctgccttccaaagacttctggtactctgtggtcaacggggtcatctttaactgcttggccgtgcttgccctgtcatcccacctgagaaccatgctcaccgaccctggggcagtacccaaaggaaacgctacgaaagaatacatggagagcttgcagctgaagcccggggaagtcatctacaagtgccccaagtgctgctgtattaaacccgagcgcgcccaccactgcagtatttgcaaaagatgtattcggaaaatggatcatcactgcccgtgggtgaacaattgtgtaggagaaaagaatcaaagattttttgtgctcttcactatgtatatagctctgtcttcagtccatgctctgatcctttgtggatttcagttcatctcctgtgtccgagggcagtggactgaatgcagtgatttttcacctccgataactgtaatcctgttgatcttcctgtgccttgagggtcttctgtttttcactttcactgcagttatgtttggcacccaaatccactccatatgcaacgacgagacggagatcgagcgattgaaaagtgagaagcccacatgggagcggaggctgcgatgggaagggatgaagtccgtctttggggggcccccctcactcctctggatgaatccctttgtgggcttccgatttaggcgactgcccacgagacccagaaaaggcggcccggagttctcagtgtgaggcgtggctcatcagactgaaacttgctcacagacttccagttatttatttggggtctgaaggatatcaacagctcatctgtgaccaacagggcaactggaacctacacaaaccaattgcttgcagcaagcagagttttatatatttatagtcacagatggcagaggaagaggctctcagtccccacctgtacaacaacggaaaggtgtgtggccacacgaagaagccaaacgccgtggcctcctgcagagctggggcttctgtggagaatacttcgggttattacatgggttattcaaatcctgggtcctgagctgctgtttccaatcatgaagaaaaacagtgaatccagtgaacagggattctccaagcagtcatttcagggggctcctgctgaccccgccactcagcagtgcactccccggatcacagcagggcgtttacatagaaagacgttttggtctcgattagctccgatgctttgcactgaagttgcaaaagatctgtgcactgaacagtgaaggtggcttccggcacactccccgctgccccggaagagacatcctttgaccctctcagcaagtctgtgtgtgtgcgtgtctgtgcgtgtgcgcgcgtgtgtgcatgtgtgtcaaaattgccagtgttgtttaggcaatgtaacatttaccggctgtgtacagcaaacaagctattttttagaaaccgacgtttcagggaagaggggagagagccgcggggtcctgcccgtggttactatgaatgtattgctgttggaggacatctcgatccaaagaacagccgttcctgtgcggcccttcgttgccctcctgctttcattttttaaagaaatcttgagtgcttgagggccttggaactgattttttttttttgttccagccaaattagcagtgtataaatggcacctaggtaagagcagagctgcggctcggtgacttgatacttggggcagcccgatgctgtgtgtggggcaggggaggcatccttactggagaggcagggcccagccattgggcacctctgggaaggggaggggaccatgaggcagccagcccctggcaggggcgactgtgccaccgcaggcagcgctccagtcgggaatggccaggatggcgccctcttgttggagtttttggttagcttttacgttttcttctccacccacggcacaggtgataaaataggatccttggtgcggagcttaaaattatgccagaaagccaacagctcccctcgtggggccttgccttaaacttgcctggtttgtacattttttgccggacgcatcaagaagcaatctgtgacaaagtctgagggtcttcctttatgcttgccctccacactaagagaagttggcgtctccctcctgggaattgttttgcctttctgttcatctgtgaactgttttttgtttttaattactctgtaccccatccgaatcagggcttctaccactgctgatgcaaaaccacaaagggacctacctgagccaccgtcctagccaagcgagcaaacctgcagggggtttggaagtggacttggtcaccgcagaagcgtgtgcgccgttgggggaagagctgcgtcacagccagagggacaaagtgtgggtgatcctggagacgccagtttccgagattgttctgcatattcatttgcacattgttgtctgggttggacatgcgtgtgggcttcagtgtgaggcttttaatatgtatatcctgttatcaataaaacaattatccaagtggttgaatcctgtgagacttggcaagtgtgtgcaaatcaagtatacttgacttttcaacctcttctttcaatgtaacttttatatgaaataaagtaatcaattaacagttctca

SEQ ID NO: 436793 - DNA, 3309 bp, Homo sapiens
acttccggcgctcgcaccgccccgctctccagccaaggctccgggctgaggcatttgcttggctgcagcctccttccgacctgcccggcgggacccaggggaccaagccgagccgagccgcggggcccgctccagcccggccatgagcgcggccgcatgatgcgtccctgcctcggccgctgcagtcgccgccgccgccgccgcaggccgggaggagccgcagcgccgggcgaccccgcccgggcctcggatccgatcacataggacagtatgcaccttaagatcctgaagaaacggcacaaaatgttcaagtgatgtttagaaataacttgtgagggtgcgtcagggaaatcatgcagccatcaggacacaggctccgggacgtcgagcatcatcctctcctggctgaaaatgacaactatgactcttcatcgtcctcctcctccgaggctgacgtggctgaccgggtctggttcatccgtgacggctgcggcatgatctgtgctgtcatgacgtggcttctggtcgcctatgcagacttcgtggtgactttcgtcatgctgctgccttccaaagacttctggtactctgtggtcaacggggtcatctttaactgcttggccgtgcttgccctgtcatcccacctgagaaccatgctcaccgaccctgaaaaatccagtgactgccgaccatctgcctgcacagtgaaaactgggctggacccaacccttgtgggcatttgtggtgagggaaccgagtctgtgcaaagcctcctgcttggggcagtacccaaaggaaacgctacgaaagaatacatggagagcttgcagctgaagcccggggaagtcatctacaagtgccccaagtgctgctgtattaaacccgagcgcgcccaccactgcagagcatggaatactgaaaaatcaaactctccttttcagtatttgcaaaagatgtattcggaaaatggatcatcactgcccgtgggtgaacaattgtgtaggagaaaagaatcaaagattttttgtgctcttcactatgtatatagctctgtcttcagtccatgctctgatcctttgtggatttcagttcatctcctgtgtccgagggcagtggactgaatgcagtgatttttcacctccgataactgtaatcctgttgatcttcctgtgccttgagggtcttctgtttttcactttcactgcagttatgtttggcacccaaatccactccatatgcaacgacgagacggagatcgagcgattgaaaagtgagaagcccacatgggagcggaggctgcgatgggaagggatgaagtccgtctttggggggcccccctcactcctctggatgaatccctttgtgggcttccgatttaggcgactgcccacgagacccagaaaaggcggcccggagttctcagtgtgaggcgtggctcatcagactgaaacttgctcacagacttccagttatttatttggggtctgaaggatatcaacagctcatctgtgaccaacagggcaactggaacctacacaaaccaattgcttgcagcaagcagagttttatatatttatagtcacagatggcagaggaagaggctctcagtccccacctgtacaacaacggaaaggtgtgtggccacacgaagaagccaaacgccgtggcctcctgcagagctggggcttctgtggagaatacttcgggttattacatgggttattcaaatcctgggtcctgagctgctgtttccaatcatgaagaaaaacagtgaatccagtgaacagggattctccaagcagtcatttcagggggctcctgctgaccccgccactcagcagtgcactccccggatcacagcagggcgtttacatagaaagacgttttggtctcgattagctccgatgctttgcactgaagttgcaaaagatctgtgcactgaacagtgaaggtggcttccggcacactccccgctgccccggaagagacatcctttgaccctctcagcaagtctgtgtgtgtgcgtgtctgtgcgtgtgcgcgcgtgtgtgcatgtgtgtcaaaattgccagtgttgtttaggcaatgtaacatttaccggctgtgtacagcaaacaagctattttttagaaaccgacgtttcagggaagaggggagagagccgcggggtcctgcccgtggttactatgaatgtattgctgttggaggacatctcgatccaaagaacagccgttcctgtgcggcccttcgttgccctcctgctttcattttttaaagaaatcttgagtgcttgagggccttggaactgattttttttttttgttccagccaaattagcagtgtataaatggcacctaggtaagagcagagctgcggctcggtgacttgatacttggggcagcccgatgctgtgtgtggggcaggggaggcatccttactggagaggcagggcccagccattgggcacctctgggaaggggaggggaccatgaggcagccagcccctggcaggggcgactgtgccaccgcaggcagcgctccagtcgggaatggccaggatggcgccctcttgttggagtttttggttagcttttacgttttcttctccacccacggcacaggtgataaaataggatccttggtgcggagcttaaaattatgccagaaagccaacagctcccctcgtggggccttgccttaaacttgcctggtttgtacattttttgccggacgcatcaagaagcaatctgtgacaaagtctgagggtcttcctttatgcttgccctccacactaagagaagttggcgtctccctcctgggaattgttttgcctttctgttcatctgtgaactgttttttgtttttaattactctgtaccccatccgaatcagggcttctaccactgctgatgcaaaaccacaaagggacctacctgagccaccgtcctagccaagcgagcaaacctgcagggggtttggaagtggacttggtcaccgcagaagcgtgtgcgccgttgggggaagagctgcgtcacagccagagggacaaagtgtgggtgatcctggagacgccagtttccgagattgttctgcatattcatttgcacattgttgtctgggttggacatgcgtgtgggcttcagtgtgaggcttttaatatgtatatcctgttatcaataaaacaattatccaagtggttgaatcctgtgagacttggcaagtgtgtgcaaatcaagtatacttgacttttcaacctcttctttcaatgtaacttttatatgaaataaagtaatcaattaacagttctca

SEQ ID NO: 436794 - DNA, 2551 bp, Homo sapiens
gcctgatgtttttaactttcattctccccaactaaagtacattcttcttatatggtagggggcagtacccaaaggaaacgctacgaaagaatacatggagagcttgcagctgaagcccggggaagtcatctacaagtgccccaagtgctgctgtattaaacccgagcgcgcccaccactgcagtatttgcaaaagatgtattcggaaaatggatcatcactgcccgtgggtgaacaattgtgtaggagaaaagaatcaaagattttttgtgctcttcactatgtatatagctctgtcttcagtccatgctctgatcctttgtggatttcagttcatctcctgtgtccgagggcagtggactgaatgcagtgatttttcacctccgataactgtaatcctgttgatcttcctgtgccttgagggtcttctgtttttcactttcactgcagttatgtttggcacccaaatccactccatatgcaacgacgagacggagatcgagcgattgaaaagtgagaagcccacatgggagcggaggctgcgatgggaagggatgaagtccgtctttggggggcccccctcactcctctggatgaatccctttgtgggcttccgatttaggcgactgcccacgagacccagaaaaggcggcccggagttctcagtgtgaggcgtggctcatcagactgaaacttgctcacagacttccagttatttatttggggtctgaaggatatcaacagctcatctgtgaccaacagggcaactggaacctacacaaaccaattgcttgcagcaagcagagttttatatatttatagtcacagatggcagaggaagaggctctcagtccccacctgtacaacaacggaaaggtgtgtggccacacgaagaagccaaacgccgtggcctcctgcagagctggggcttctgtggagaatacttcgggttattacatgggttattcaaatcctgggtcctgagctgctgtttccaatcatgaagaaaaacagtgaatccagtgaacagggattctccaagcagtcatttcagggggctcctgctgaccccgccactcagcagtgcactccccggatcacagcagggcgtttacatagaaagacgttttggtctcgattagctccgatgctttgcactgaagttgcaaaagatctgtgcactgaacagtgaaggtggcttccggcacactccccgctgccccggaagagacatcctttgaccctctcagcaagtctgtgtgtgtgcgtgtctgtgcgtgtgcgcgcgtgtgtgcatgtgtgtcaaaattgccagtgttgtttaggcaatgtaacatttaccggctgtgtacagcaaacaagctattttttagaaaccgacgtttcagggaagaggggagagagccgcggggtcctgcccgtggttactatgaatgtattgctgttggaggacatctcgatccaaagaacagccgttcctgtgcggcccttcgttgccctcctgctttcattttttaaagaaatcttgagtgcttgagggccttggaactgattttttttttttgttccagccaaattagcagtgtataaatggcacctaggtaagagcagagctgcggctcggtgacttgatacttggggcagcccgatgctgtgtgtggggcaggggaggcatccttactggagaggcagggcccagccattgggcacctctgggaaggggaggggaccatgaggcagccagcccctggcaggggcgactgtgccaccgcaggcagcgctccagtcgggaatggccaggatggcgccctcttgttggagtttttggttagcttttacgttttcttctccacccacggcacaggtgataaaataggatccttggtgcggagcttaaaattatgccagaaagccaacagctcccctcgtggggccttgccttaaacttgcctggtttgtacattttttgccggacgcatcaagaagcaatctgtgacaaagtctgagggtcttcctttatgcttgccctccacactaagagaagttggcgtctccctcctgggaattgttttgcctttctgttcatctgtgaactgttttttgtttttaattactctgtaccccatccgaatcagggcttctaccactgctgatgcaaaaccacaaagggacctacctgagccaccgtcctagccaagcgagcaaacctgcagggggtttggaagtggacttggtcaccgcagaagcgtgtgcgccgttgggggaagagctgcgtcacagccagagggacaaagtgtgggtgatcctggagacgccagtttccgagattgttctgcatattcatttgcacattgttgtctgggttggacatgcgtgtgggcttcagtgtgaggcttttaatatgtatatcctgttatcaataaaacaattatccaagtggttgaatcctgtgagacttggcaagtgtgtgcaaatcaagtatacttgacttttcaacctcttctttcaatgtaacttttatatgaaataaagtaatcaattaacagttctca

SEQ ID NO: 436795 - DNA, 3553 bp, Homo sapiens
acttccggcgctcgcaccgccccgctctccagccaaggctccgggctgaggcatttgcttggctgcagcctccttccgacctgcccggcgggacccaggggaccaagccgagccgagccgcggggcccgctccagcccggccatgagcgcggccgcatgatgcgtccctgcctcggccgctgcagtcgccgccgccgccgccgcaggccgggaggagccgcagcgccgggcgaccccgcccgggcctcggatccgatcacataggacagtatgcaccttaagatcctgaagaaacggcacaaaatgttcaagtgatgtttagaaataacttgtgagggtgcgtcagggaaatcatgcagccatcaggacacaggctccgggacgtcgagcatcatcctctcctggctgaaaatgacaactatgactcttcatcgtcctcctcctccgaggctgacgtggctgaccgggtctggttcatccgtgacggctgcggcatgatctgtgctgtcatgacgtggcttctggtcgcctatgcagacttcgtggtgactttcgtcatgctgctgccttccaaagacttctggtactctgtggtcaacggggtcatctttaactgcttggccgtgcttgccctgtcatcccacctgagaaccatgctcaccgaccctgaaaaatccagtgactgccgaccatctgcctgcacagtgaaaactgggctggacccaacccttgtgggcatttgtggtgagggaaccgagtctgtgcaaagcctcctgcttggggcagtacccaaaggaaacgctacgaaagaatacatggagagcttgcagctgaagcccggggaagtcatctacaagtgccccaagtgctgctgtattaaacccgagcgcgcccaccactgcagtatttgcaaaagatgtattcggaaaatggatcatcactgcccgtgggtgaacaattgtgtaggagaaaagaatcaaagattttttgtgctcttcactatgtatatagctctgtcttcagtccatgctctgatcctttgtggatttcagttcatctcctgtgtccgagggcagtggactgaatgcagtgatttttcacctccgataactgtaatcctgttgatcttcctgtgccttgagggtcttctgtttttcactttcactgcagttatgtttggcacccaaatccactccatatgcaacgacgagacggagatcgagcgattgaaaagtgagaagcccacatgggagcggaggctgcgatgggaagggatgaagtccgtctttggggggcccccctcactcctctggatgaatccctttgtgggcttccgatttaggcgactgcccacgagacccagaaaaggcggcccggagttctcagtgtgaggcgtggctcatcagactgaaacttgctcacagacttccagttatttatttggggtctgaaggatatcaacagctcatctgtgaccaacagggcaactggaacctacacaaaccaattgcttgcagcaagcagagttttatatatttatagtcacagatggcagaggaagaggctctcagtccccacctgtacaacaacggaaaggtgtgtggccacacgaagaagccaaacgccgtggcctcctgcagagctggggcttctgtggagaatacttcgggttattacatgggttattcaaatcctgggtcctgagctgctgtttccaatcatgaagaaaaacagtgaatccagtgaacagggattctccaagcagtcatttcagggggctcctgctgaccccgccactcagcagtgcactccccggatcacagcagggcgtttacatagaaagacgttttggtctcgattagctccgatgctttgcactgaagttgcaaaagatctgtgcactgaacagtgaaggtggcttccggcacactccccgctgccccggaagagacatcctttgaccctctcagcaagtctgtgtgtgtgcgtgtctgtgcgtgtgcgcgcgtgtgtgcatgtgtgtcaaaattgccagtgttgtttaggcaatgtaacatttaccggctgtgtacagcaaacaagctattttttagaaaccgacgtttcagggaagaggggagagagccgcggggtcctgcccgtggttactatgaatgtattgctgttggaggacatctcgatccaaagaacagccgttcctgtgcggcccttcgttgccctcctgctttcattttttaaagaaatcttgagtgcttgagggccttggaactgattttttttttttgttccagccaaattagcagtgtataaatggcacctaggtaagagcagagctgcggctcggtgacttgatacttggggcagcccgatgctgtgtgtggggcaggggaggcatccttactggagaggcagggcccagccattgggcacctctgggaaggggaggggaccatgaggcagccagcccctggcaggggcgactgtgccaccgcaggcagcgctccagtcgggaatggccaggatggcgccctcttgttggagtttttggttagcttttacgttttcttctccacccacggcacaggtgataaaataggatccttggtgcggagcttaaaattatgccagaaagccaacagctcccctcgtggggccttgccttaaacttgcctggtttgtacattttttgccggacgcatcaagaagcaatctgtgacaaagtctgagggtcttcctttatgcttgccctccacactaagagaagttggcgtctccctcctgggaattgttttgcctttctgttcatctgtgaactgttttttgtttttaattactctgtaccccatccgaatcagggcttctaccactgctgatgcaaaaccacaaagggacctacctgagccaccgtcctagccaagcgagcaaacctgcagggggtttggaagtggacttggtcaccgcagaagcgtgtgcgccgttgggggaagagctgcgtcacagccagagggacaaagtgtgggtgatcctggagacgccagtttccgagattgttctgcatattcatttgcacattgttgtctgggttggacatgcgtgtgggcttcagtgtgaggcttttaatatgtatatcctgttatcaataaaacaattatccaagtggttgaatcctgtgagacttggcaagtgtgtgcaaatcaagtatacttgacttttcaacctcttctttcaatgtaacttttatatgaaataaagtaatcaattaacagttctcaaatggcttccaaagcgcccgttcttcctggatggtggtgttttcagggggtgcctttccgtgcttcgtgggcccagccccaggctgttaaggtcactcccaaacagtttccagaaactctaaatgcttttgtgcccatgacaagtgacctgggcactcaagcgcgactcacaaatgttgcccagtgagtactgttgcttgttgaatgtttaattcgactcccatcgttttacttagtcctttttttagtgcacgttgaaataaaaacaatgtttcaaaatc

SEQ ID NO: 436796 - DNA, 3019 bp, Homo sapiens
acttccggcgctcgcaccgccccgctctccagccaaggctccgggctgaggcatttgcttggctgcagcctccttccgacctgcccggcgggacccaggggaccaagccgagccgagccgcggggcccgctccagcccggccatgagcgcggccgcatgatgcgtccctgcctcggccgctgcagtcgccgccgccgccgccgcaggccgggaggagccgcagcgccgggcgaccccgcccgggcctcggatccgatcacataggacagtatgcaccttaagatcctgaagaaacggcacaaaatgttcaagtgatgtttagaaataacttgtgagggtgcgtcagggaaatcatgcagccatcaggacacaggctccgggacgtcgagcatcatcctctcctggctgaaaatgacaactatgactcttcatcgtcctcctcctccgaggctgacgtggctgaccgggtctggttcatccgtgacggctgcggcatgatctgtgctgtcatgacgtggcttctggtcgcctatgcagacttcgtggtgactttcgtcatgctgctgccttccaaagacttctggtactctgtggtcaacggggtcatctttaactgcttggccgtgcttgccctgtcatcccacctgagaaccatgctcaccgaccctgaaaaatccagtgactgccgaccatctgcctgcacagtgaaaactgggctggacccaacccttgtgggcatttgtggtgagggaaccgagtctgtgcaaagcctcctgcttggggcagtacccaaaggaaacgctacgaaagaatacatggagagcttgcagctgaagcccggggaagtcatctacaagtgccccaagtgctgctgtattaaacccgagcgcgcccaccactgcagtatttgcaaaagatgtattcggaaaatggatcatcactgcccgtgggtgaacaattgtgtaggagaaaagaatcaaagattttttgtgctcttcactatgtatatagctctgtcttcagtccatgctctgatcctttgtggatttcagttcatctcctgtgtccgagggcagtggactgaatgcagtgatttttcacctccgataactgtaatcctgttgatcttcctgtgccttgagggtcttctgtttttcactttcactgcagttatgtttggcacccaaatccactccatatgcaacgacgagacggagatcgagcgattgaaaagtgagaagcccacatgggagcggaggctgcgatgggaagggatgaagtccgtctttggggggcccccctcactcctctggatgaatccctttgtgggcttccgatttaggcgactgcccacgagacccagaaaaggcggcccggagttctcagtgtgaggcgtggctcatcagactgaaacttgctcacagacttccagttatttatttggggtctgaaggatatcaacagctcatctgtgaccaacagggcaactggaacctacacaaaccaattgcttgcagcaagcagagttttatatatttatagtcacagatggcagaggaagaggctctcagtccccacctgtacaacaacggaaaggtgtgtggccacacgaagaagccaaacgccgtggcctcctgcagagctggggcttctgtggagaatacttcgggttattacatgggttattcaaatcctgggtcctgagctgctgtttccaatcatgaagaaaaacagtgaatccagtgaacagggattctccaagcagtcatttcagggggctcctgctgaccccgccactcagcagtgcactccccggatcacagcagggcgtttacatagaaagacgttttggtctcgattagctccgatgctttgcactgaagttgcaaaagatctgtgcactgaacagtgaaggtggcttccggcacactccccgctgccccggaagagacatcctttgaccctctcagcaagtctgtgtgtgtgcgtgtctgtgcgtgtgcgcgcgtgtgtgcatgtgtgtcaaaattgccagtgttgtttaggcaatgtaacatttaccggctgtgtacagcaaacaagctattttttagaaaccgacgtttcagggaagaggggagagagccgcggggtcctgcccgtggttactatgaatgtattgctgttggaggacatctcgatccaaagaacagccgttcctgtgcggcccttcgttgccctcctgctttcattttttaaagaaatcttgagtgcttgagggccttggaactgattttttttttttgttccagccaaattagcagtgtataaatggcacctagggcttctaccactgctgatgcaaaaccacaaagggacctacctgagccaccgtcctagccaagcgagcaaacctgcagggggtttggaagtggacttggtcaccgcagaagcgtgtgcgccgttgggggaagagctgcgtcacagccagagggacaaagtgtgggtgatcctggagacgccagtttccgagattgttctgcatattcatttgcacattgttgtctgggttggacatgcgtgtgggcttcagtgtgaggcttttaatatgtatatcctgttatcaataaaacaattatccaagtggttgaatcctgtgagacttggcaagtgtgtgcaaatcaagtatacttgacttttcaacctcttctttcaatgtaacttttatatgaaataaagtaatcaattaacagttctcaaatggcttccaaagcgcccgttcttcctggatggtggtgttttcagggggtgcctttccgtgcttcgtgggcccagccccaggctgttaaggtcactcccaaacagtttccagaaactctaaatgcttttgtgcccatgacaagtgacctgggcactcaagcgcgactcacaaatgttgcccagtgagtactgttgcttgttgaatgtttaattcgactcccatcgttttacttagtcctttttttagtgcacgttgaaataaaaacaatgtttcaaaatc

SEQ ID NO: 436797 - DNA, 877 bp, Homo sapiens
acttccggcgctcgcaccgccccgctctccagccaaggctccgggctgaggcatttgcttggctgcagcctccttccgacctgcccggcgggacccaggggaccaagccgagccgagccgcggggcccgctccagcccggccatgagcgcggccgcatgatgcgtccctgcctcggccgctgcagtcgccgccgccgccgccgcaggccgggaggagccgcagcgccgggcgaccccgcccgggcctcggatccgatcacataggacagtatgcaccttaagatcctgaagaaacggcacaaaatgttcaagtgatgtttagaaataacttgtgagggtgcgtcagggaaatcatgcagccatcaggacacaggctccgggacgtcgagcatcatcctctcctggctgaaaatgacaactatgactcttcatcgtcctcctcctccgaggctgacgtggctgaccgggtctggttcatccgtgacggctgcggcatgatctgtgctgtcatgacgtggcttctggtcgcctatgcagacttcgtggtgactttcgtcatgctgctgccttccaaagacttctggtactctgtggtcaacggggtcatctttaactgcttggccgtgcttgccctgtcatcccacctgagaaccatgctcaccgaccctgtgagtactggctgcgtctctgggtggctctcttgtgtctggtctagtgtcctcgggtgtggctgaccctttggaggaagcagtgcacagggacatattgacatgggtgtggaacaagaaaggtggattgagctcattttgggagcagattccctttaggctgagaataaacataggccagacctagcgcagtgaaatacccctagttc

SEQ ID NO: 436798 - DNA, 3161 bp, Homo sapiens
acttccggcgctcgcaccgccccgctctccagccaaggctccgggctgaggcatttgcttggctgcagcctccttccgacctgcccggcgggacccaggggaccaagccgagccgagccgcggggcccgctccagcccggccatgagcgcggccgcatgatgcgtccctgcctcggccgctgcagtcgccgccgccgccgccgcaggccgggaggagccgcagcgccgggcgaccccgcccgggcctcggatccgatcacataggacagtatgcaccttaagatcctgaagaaacggcacaaaatgttcaagtgatgtttagaaataacttgtgagggtgcgtcagggaaatcatgcagccatcaggacacaggctccgggacgtcgagcatcatcctctcctggctgaaaatgacaactatgactcttcatcgtcctcctcctccgaggctgacgtggctgaccgggtctggttcatccgtgacggctgcggcatgatctgtgctgtcatgacgtggcttctggtcgcctatgcagacttcgtggtgactttcgtcatgctgctgccttccaaagacttctggtactctgtggtcaacggggtcatctttaactgcttggccgtgcttgccctgtcatcccacctgagaaccatgctcaccgaccctggggcagtacccaaaggaaacgctacgaaagaatacatggagagcttgcagctgaagcccggggaagtcatctacaagtgccccaagtgctgctgtattaaacccgagcgcgcccaccactgcagtatttgcaaaagatgtattcggaaaatggatcatcactgcccgtgggtgaacaattgtgtaggagaaaagaatcaaagattttttgtgctcttcactatgtatatagctctgtcttcagtccatgctctgatcctttgtggatttcagttcatctcctgtgtccgagggcagtggactgaatgcagtgatttttcacctccgataactgtaatcctgttgatcttcctgtgccttgagggtcttctgtttttcactttcactgcagttatgtttggcacccaaatccactccatatgcaacgacgagacggagatcgagcgattgaaaagtgagaagcccacatgggagcggaggctgcgatgggaagggatgaagtccgtctttggggggcccccctcactcctctggatgaatccctttgtgggcttccgatttaggcgactgcccacgagacccagaaaaggcggcccggagttctcagtgtgaggcgtggctcatcagactgaaacttgctcacagacttccagttatttatttggggtctgaaggatatcaacagctcatctgtgaccaacagggcaactggaacctacacaaaccaattgcttgcagcaagcagagttttatatatttatagtcacagatggcagaggaagaggctctcagtccccacctgtacaacaacggaaaggtgtgtggccacacgaagaagccaaacgccgtggcctcctgcagagctggggcttctgtggagaatacttcgggttattacatgggttattcaaatcctgggtcctgagctgctgtttccaatcatgaagaaaaacagtgaatccagtgaacagggattctccaagcagtcatttcagggggctcctgctgaccccgccactcagcagtgcactccccggatcacagcagggcgtttacatagaaagacgttttggtctcgattagctccgatgctttgcactgaagttgcaaaagatctgtgcactgaacagtgaaggtggcttccggcacactccccgctgccccggaagagacatcctttgaccctctcagcaagtctgtgtgtgtgcgtgtctgtgcgtgtgcgcgcgtgtgtgcatgtgtgtcaaaattgccagtgttgtttaggcaatgtaacatttaccggctgtgtacagcaaacaagctattttttagaaaccgacgtttcagggaagaggggagagagccgcggggtcctgcccgtggttactatgaatgtattgctgttggaggacatctcgatccaaagaacagccgttcctgtgcggcccttcgttgccctcctgctttcattttttaaagaaatcttgagtgcttgagggccttggaactgattttttttttttgttccagccaaattagcagtgtataaatggcacctaggtaagagcagagctgcggctcggtgacttgatacttggggcagcccgatgctgtgtgtggggcaggggaggcatccttactggagaggcagggcccagccattgggcacctctgggaaggggaggggaccatgaggcagccagcccctggcaggggcgactgtgccaccgcaggcagcgctccagtcgggaatggccaggatggcgccctcttgttggagtttttggttagcttttacgttttcttctccacccacggcacaggtgataaaataggatccttggtgcggagcttaaaattatgccagaaagccaacagctcccctcgtggggccttgccttaaacttgcctggtttgtacattttttgccggacgcatcaagaagcaatctgtgacaaagtctgagggtcttcctttatgcttgccctccacactaagagaagttggcgtctccctcctgggaattgttttgcctttctgttcatctgtgaactgttttttgtttttaattactctgtaccccatccgaatcagggcttctaccactgctgatgcaaaaccacaaagggacctacctgagccaccgtcctagccaagcgagcaaacctgcagggggtttggaagtggacttggtcaccgcagaagcgtgtgcgccgttgggggaagagctgcgtcacagccagagggacaaagtgtgggtgatcctggagacgccagtttccgagattgttctgcatattcatttgcacattgttgtctgggttggacatgcgtgtgggcttcagtgtgaggcttttaatatgtatatcctgttatcaataaaacaattatccaagtggttgaatcctgtgagacttggcaagtgtgtgcaaatcaagtatacttgacttttcaacctcttctttcaatgtaacttttatatgaaataaagtaatcaattaacagttctca

SEQ ID NO: 436799 - DNA, 3272 bp, Homo sapiens
acttccggcgctcgcaccgccccgctctccagccaaggctccgggctgaggcatttgcttggctgcagcctccttccgacctgcccggcgggacccaggggaccaagccgagccgagccgcggggcccgctccagcccggccatgagcgcggccgcatgatgcgtccctgcctcggccgctgcagtcgccgccgccgccgccgcaggccgggaggagccgcagcgccgggcgaccccgcccgggcctcggatccgatcacataggacagtatgcaccttaagatcctgaagaaacggcacaaaatgttcaagtgatgtttagaaataacttgtgagggtgcgtcagggaaatcatgcagccatcaggacacaggctccgggacgtcgagcatcatcctctcctggctgaaaatgacaactatgactcttcatcgtcctcctcctccgaggctgacgtggctgaccgggtctggttcatccgtgacggctgcggcatgatctgtgctgtcatgacgtggcttctggtcgcctatgcagacttcgtggtgactttcgtcatgctgctgccttccaaagacttctggtactctgtggtcaacggggtcatctttaactgcttggccgtgcttgccctgtcatcccacctgagaaccatgctcaccgaccctgaaaaatccagtgactgccgaccatctgcctgcacagtgaaaactgggctggacccaacccttgtgggcatttgtggtgagggaaccgagtctgtgcaaagcctcctgcttggggcagtacccaaaggaaacgctacgaaagaatacatggagagcttgcagctgaagcccggggaagtcatctacaagtgccccaagtgctgctgtattaaacccgagcgcgcccaccactgcagtatttgcaaaagatgtattcggaaaatggatcatcactgcccgtgggtgaacaattgtgtaggagaaaagaatcaaagattttttgtgctcttcactatgtatatagctctgtcttcagtccatgctctgatcctttgtggatttcagttcatctcctgtgtccgagggcagtggactgaatgcagtgatttttcacctccgataactgtaatcctgttgatcttcctgtgccttgagggtcttctgtttttcactttcactgcagttatgtttggcacccaaatccactccatatgcaacgacgagacggagatcgagcgattgaaaagtgagaagcccacatgggagcggaggctgcgatgggaagggatgaagtccgtctttggggggcccccctcactcctctggatgaatccctttgtgggcttccgatttaggcgactgcccacgagacccagaaaaggcggcccggagttctcagtgtgaggcgtggctcatcagactgaaacttgctcacagacttccagttatttatttggggtctgaaggatatcaacagctcatctgtgaccaacagggcaactggaacctacacaaaccaattgcttgcagcaagcagagttttatatatttatagtcacagatggcagaggaagaggctctcagtccccacctgtacaacaacggaaaggtgtgtggccacacgaagaagccaaacgccgtggcctcctgcagagctggggcttctgtggagaatacttcgggttattacatgggttattcaaatcctgggtcctgagctgctgtttccaatcatgaagaaaaacagtgaatccagtgaacagggattctccaagcagtcatttcagggggctcctgctgaccccgccactcagcagtgcactccccggatcacagcagggcgtttacatagaaagacgttttggtctcgattagctccgatgctttgcactgaagttgcaaaagatctgtgcactgaacagtgaaggtggcttccggcacactccccgctgccccggaagagacatcctttgaccctctcagcaagtctgtgtgtgtgcgtgtctgtgcgtgtgcgcgcgtgtgtgcatgtgtgtcaaaattgccagtgttgtttaggcaatgtaacatttaccggctgtgtacagcaaacaagctattttttagaaaccgacgtttcagggaagaggggagagagccgcggggtcctgcccgtggttactatgaatgtattgctgttggaggacatctcgatccaaagaacagccgttcctgtgcggcccttcgttgccctcctgctttcattttttaaagaaatcttgagtgcttgagggccttggaactgattttttttttttgttccagccaaattagcagtgtataaatggcacctaggtaagagcagagctgcggctcggtgacttgatacttggggcagcccgatgctgtgtgtggggcaggggaggcatccttactggagaggcagggcccagccattgggcacctctgggaaggggaggggaccatgaggcagccagcccctggcaggggcgactgtgccaccgcaggcagcgctccagtcgggaatggccaggatggcgccctcttgttggagtttttggttagcttttacgttttcttctccacccacggcacaggtgataaaataggatccttggtgcggagcttaaaattatgccagaaagccaacagctcccctcgtggggccttgccttaaacttgcctggtttgtacattttttgccggacgcatcaagaagcaatctgtgacaaagtctgagggtcttcctttatgcttgccctccacactaagagaagttggcgtctccctcctgggaattgttttgcctttctgttcatctgtgaactgttttttgtttttaattactctgtaccccatccgaatcagggcttctaccactgctgatgcaaaaccacaaagggacctacctgagccaccgtcctagccaagcgagcaaacctgcagggggtttggaagtggacttggtcaccgcagaagcgtgtgcgccgttgggggaagagctgcgtcacagccagagggacaaagtgtgggtgatcctggagacgccagtttccgagattgttctgcatattcatttgcacattgttgtctgggttggacatgcgtgtgggcttcagtgtgaggcttttaatatgtatatcctgttatcaataaaacaattatccaagtggttgaatcctgtgagacttggcaagtgtgtgcaaatcaagtatacttgacttttcaacctcttctttcaatgtaacttttatatgaaataaagtaatcaattaacagttctca

SEQ ID NO: 436800 - DNA, 2989 bp, Homo sapiens
ctgtcctgggaatgggacagtattataggcccaaccagagggcagctggggagtggtaccttggggacaaacttggaagcaaagtctgccagtggctttgtagcctgatctgatggtggagtctttgaccataactgagtctcttcgatgggtttgtgccttcagagaattaaagcctgtcttgtcatttccttttacgcggcaggtctccctctaggagccagaccctgctcctgatccctgtgtgtctccgccctctccttccttggctgcagcagaaaccccttgtttgttgcccaaagtgcccaggcacttcgacaaaggagagggccagctacagggccaggtccagctcagcgatttttactggaatattgccttgtaggaaaaatccagtgactgccgaccatctgcctgcacagtgaaaactgggctggacccaacccttgtgggcatttgtggtgagggaaccgagtctgtgcaaagcctcctgcttggggcagtacccaaaggaaacgctacgaaagaatacatggagagcttgcagctgaagcccggggaagtcatctacaagtgccccaagtgctgctgtattaaacccgagcgcgcccaccactgcagtatttgcaaaagatgtattcggaaaatggatcatcactgcccgtgggtgaacaattgtgtaggagaaaagaatcaaagattttttgtgctcttcactatgtatatagctctgtcttcagtccatgctctgatcctttgtggatttcagttcatctcctgtgtccgagggcagtggactgaatgcagtgatttttcacctccgataactgtaatcctgttgatcttcctgtgccttgagggtcttctgtttttcactttcactgcagttatgtttggcacccaaatccactccatatgcaacgacgagacggagatcgagcgattgaaaagtgagaagcccacatgggagcggaggctgcgatgggaagggatgaagtccgtctttggggggcccccctcactcctctggatgaatccctttgtgggcttccgatttaggcgactgcccacgagacccagaaaaggcggcccggagttctcagtgtgaggcgtggctcatcagactgaaacttgctcacagacttccagttatttatttggggtctgaaggatatcaacagctcatctgtgaccaacagggcaactggaacctacacaaaccaattgcttgcagcaagcagagttttatatatttatagtcacagatggcagaggaagaggctctcagtccccacctgtacaacaacggaaaggtgtgtggccacacgaagaagccaaacgccgtggcctcctgcagagctggggcttctgtggagaatacttcgggttattacatgggttattcaaatcctgggtcctgagctgctgtttccaatcatgaagaaaaacagtgaatccagtgaacagggattctccaagcagtcatttcagggggctcctgctgaccccgccactcagcagtgcactccccggatcacagcagggcgtttacatagaaagacgttttggtctcgattagctccgatgctttgcactgaagttgcaaaagatctgtgcactgaacagtgaaggtggcttccggcacactccccgctgccccggaagagacatcctttgaccctctcagcaagtctgtgtgtgtgcgtgtctgtgcgtgtgcgcgcgtgtgtgcatgtgtgtcaaaattgccagtgttgtttaggcaatgtaacatttaccggctgtgtacagcaaacaagctattttttagaaaccgacgtttcagggaagaggggagagagccgcggggtcctgcccgtggttactatgaatgtattgctgttggaggacatctcgatccaaagaacagccgttcctgtgcggcccttcgttgccctcctgctttcattttttaaagaaatcttgagtgcttgagggccttggaactgattttttttttttgttccagccaaattagcagtgtataaatggcacctaggtaagagcagagctgcggctcggtgacttgatacttggggcagcccgatgctgtgtgtggggcaggggaggcatccttactggagaggcagggcccagccattgggcacctctgggaaggggaggggaccatgaggcagccagcccctggcaggggcgactgtgccaccgcaggcagcgctccagtcgggaatggccaggatggcgccctcttgttggagtttttggttagcttttacgttttcttctccacccacggcacaggtgataaaataggatccttggtgcggagcttaaaattatgccagaaagccaacagctcccctcgtggggccttgccttaaacttgcctggtttgtacattttttgccggacgcatcaagaagcaatctgtgacaaagtctgagggtcttcctttatgcttgccctccacactaagagaagttggcgtctccctcctgggaattgttttgcctttctgttcatctgtgaactgttttttgtttttaattactctgtaccccatccgaatcagggcttctaccactgctgatgcaaaaccacaaagggacctacctgagccaccgtcctagccaagcgagcaaacctgcagggggtttggaagtggacttggtcaccgcagaagcgtgtgcgccgttgggggaagagctgcgtcacagccagagggacaaagtgtgggtgatcctggagacgccagtttccgagattgttctgcatattcatttgcacattgttgtctgggttggacatgcgtgtgggcttcagtgtgaggcttttaatatgtatatcctgttatcaataaaacaattatccaagtggttgaatcctgtgagacttggcaagtgtgtgcaaatcaagtatacttgacttttcaacctcttctttcaatgtaacttttatatgaaataaagtaatcaattaacagttctca

SEQ ID NO: 436801 - DNA, 3218 bp, Homo sapiens
acttccggcgctcgcaccgccccgctctccagccaaggctccgggctgaggcatttgcttggctgcagcctccttccgacctgcccggcgggacccaggggaccaagccgagccgagccgcggggcccgctccagcccggccatgagcgcggccgcatgatgcgtccctgcctcggccgctgcagtcgccgccgccgccgccgcaggccgggaggagccgcagcgccgggcgaccccgcccgggcctcggatccgatcacataggacagtatgcaccttaagatcctgaagaaacggcacaaaatgttcaagtgatgtttagaaataacttgtgagggtgcgtcagggaaatcatgcagccatcaggacacaggctccgggacgtcgagcatcatcctctcctggctgaaaatgacaactatgactcttcatcgtcctcctcctccgaggctgacgtggctgaccgggtctggttcatccgtgacggctgcggcatgatctgtgctgtcatgacgtggcttctggtcgcctatgcagacttcgtggtgactttcgtcatgctgctgccttccaaagacttctggtactctgtggtcaacggggtcatctttaactgcttggccgtgcttgccctgtcatcccacctgagaaccatgctcaccgaccctgaaaaatccagtgactgccgaccatctgcctgcacagtgaaaactgggctggacccaacccttgtgggcatttgtggtgagggaaccgagtctgtgcaaagcctcctgcttggggcagtacccaaaggaaacgctacgaaagaatacatggagagcttgcagctgaagcccggggaagtcatctacaagtgccccaagtgctgctgtattaaacccgagcgcgcccaccactgcagtatttgcaaaagatgtattcggaaaatggatcatcactgcccgtgggtgaacaattgtgtaggagaaaagaatcaaagattttttgtgctcttcactatgtatatagctctgtcttcagtccatgctctgatcctttgtggatttcagttcatctcctgtgtccgagggcagtggactgaatgcagtgatttttcacctccgataactgtaatcctgttgatcttcctgtgccttgagggtcttctgtttttcactttcactgcagttatgtttggcacccaaatccactccatatgcaacgacgagacggagatcgagcgattgaaaagtgagaagcccacatgggagcggaggctgcgatgggaagggatgaagtccgtctttggggggcccccctcactcctctggatgaatccctttgtgggcttccgatttaggcgactgcccacgagacccagaaaaggcggcccggagttctcagtgtgaggcgtggctcatcagactgaaacttgctcacagacttccagttatttatttggggtctgaaggatatcaacagctcatctgtgaccaacagggcaactggaacctacacaaaccaattgcttgcagcaagcagagttttatatatttatagtcacagatggcagaggaagaggctctcagtccccacctgtacaacaacggaaaggtgtgtggccacacgaagaagccaaacgccgtggcctcctgcagagctggggcttctgtggagaatacttcgggttattacatgggttattcaaatcctgggtcctgagctgctgtttccaatcatgaagaaaaacagtgaatccagtgaacagggattctccaagcagtcatttcagggggctcctgctgaccccgccactcagcagtgcactccccggatcacagcagggcgtttacatagaaagacgttttggtctcgattagctccgatgctttgcactgaagttgcaaaagatctgtgcactgaacagtgaaggtggcttccggcacactccccgctgccccggaagagacatcctttgaccctctcagcaagtctgtgtgtgtgcgtgtctgtgcgtgtgcgcgcgtgtgtgcatgtgtgtcaaaattgccagtgttgtttaggcaatgtaacatttaccggctgtgtacagcaaacaagctattttttagaaaccgacgtttcagggaagaggggagagagccgcggggtcctgcccgtggttactatgaatgtattgctgttggaggacatctcgatccaaagaacagccgttcctgtgcggcccttcgttgccctcctgctttcattttttaaagaaatcttgagtgcttgagggccttggaactgattttttttttttgttccagccaaattagcagtgtataaatggcacctaggtaagagcagagctgcggctcggtgacttgatacttggggcagcccgatgctgtgtgtggggcaggggaggcatccttactggagaggcagggcccagccattgggcacctctgggaaggggaggggaccatgaggcagccagcccctggcaggggcgactgtgccaccgcaggcagcgctccagtcgggaatggccaggatggcgccctcttgttggagtttttggttagcttttacgttttcttctccacccacggcacaggtgataaaataggatccttggtgcggagcttaaaattatgccagaaagccaacagctcccctcgtggggccttgccttaaacttgcctggtttgtacattttttgccggacgcatcaagaagcaatctgtgacaaagtctgagggtcttcctttatgcttgccctccacactaagagaagttggcgtctccctcctgggaattgttttgcctttctgttcatctgtgaactgttttttgtttttaattactctgtaccccatccgaatcagggcttctaccactgctgatgccagggggtttggaagtggacttggtcaccgcagaagcgtgtgcgccgttgggggaagagctgcgtcacagccagagggacaaagtgtgggtgatcctggagacgccagtttccgagattgttctgcatattcatttgcacattgttgtctgggttggacatgcgtgtgggcttcagtgtgaggcttttaatatgtatatcctgttatcaataaaacaattatccaagtggttgaatcctgtgagacttggcaagtgtgtgcaaatcaagtatacttgacttttcaacctcttctttcaatgtaacttttatatgaaataaagtaatcaattaacagttctca

SEQ ID NO: 436802 - DNA, 1050 bp, Homo sapiens
acttccggcgctcgcaccgccccgctctccagccaaggctccgggctgaggcatttgcttggctgcagcctccttccgacctgcccggcgggacccaggggaccaagccgagccgagccgcggggcccgctccagcccggccatgagcgcggccgcatgatgcgtccctgcctcggccgctgcagtcgccgccgccgccgccgcaggccgggaggagccgcagcgccgggcgaccccgcccgggcctcggatccgatcacataggacagtatgcaccttaagatcctgaagaaacggcacaaaatgttcaagtgatgtttagaaataacttgtgagggtgcgtcagggaaatcatgcagccatcaggacacaggctccgggacgtcgagcatcatcctctcctggctgaaaatgacaactatgactcttcatcgtcctcctcctccgaggctgacgtggctgaccgggtctggttcatccgtgacggctgcggcatgatctgtgctgtcatgacgtggcttctggtcgcctatgcagacttcgtggtgactttcgtcatgctgctgccttccaaagacttctggtactctgtggtcaacggggtcatctttaactgcttggccgtgcttgccctgtcatcccacctgagaaccatgctcaccgaccctgaaaaatccagtgactgccgaccatctgcctgcacagtgaaaactgggctggacccaacccttgtgggcatttgtggtgagggaaccgagtctgtgcaaagcctcctgcttgtgagtgtggggtaggcacatgggggagggtcagcctggctgggagtcctcagcagtttgctcctctttgctgacaagcgcacttgccccttcctcctctgcgctcagactctacagctactcagcagtccagcttctgctcccaccccgctcctgctcctgcggaaaaggccccagaagcctggagagctggaggcggccaggaagtcagggtagaaggtgtgtgcagggcgtgctgccgccctggtgggcagatttcttttgcttgttg

SEQ ID NO: 436803 - DNA, 290 bp, Homo sapiens
tgtagagacagggtcttgctatgttgcccaggctggtgttgcaaactcctggcgtcaggcaatcttcccacgtcagcctctgaagttactgggattacaaagcatgaaccactgtgcctggtcaaatcgtgttaatttttaaagcagctgaataatgtgattaatttttagtatataaagtgttaaaagtgttaagaaggatacagtttagaaattcatattctccctctccaccttcctctcttttccacttcctttcattatatcttttttttttttttgagatgcag

SEQ ID NO: 436804 - DNA, 2215 bp, Homo sapiens
agcaggagggtgggaccaagggtgctgctggaccaaggatgggactgggccaagggtggggctgggaagcatcctgttttgcatgtttgatcaggagctgctgccaagttgtgactttcactttcccttttgggttccagggtatatctcagagactggagaacgtgtctggttattatgcagatgcacggctggaggtgggatccacacagctcagaacagctggatcttgctcacactctttcaagagaagcttccttgggttaagaaaaaaaacgaacccttccagtcaggtcagtgactggagagctccaaggaaagtctctcagtgacctggctgctggcaccatggactcagaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggaggagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaa

SEQ ID NO: 436805 - DNA, 3627 bp, Homo sapiens
actctggggaaaggagggtacaaccacatgtaaattttattataatgatggtataatgaacttggggtgacctgagggcatgtttttgtgttactgggcatgtgcccctttaggagacttccacctgtgccttactttctctttctttgggatgtgctggccacagactttaccaaaaactccatccattaggatggcattaggacggttctggggctaaacttaggtgggccaggggctgtttcactgtcagcctttctactctcttttcttacccactcctagctgctaatgtctatttaactacctaatatttccccctttagagaaaaaaagccaaatttttgggtagatcggtgacaattaatctggctacttcctgctgacaagaggcagtggtaataattgggttctcttttttgctctcttgtagctggtaggttgggcagagaaaagtggtggccatccaaggggcccacgtagatatcagacatggttgagacctcgcggtaaccttgtgtagaatcatttggagttttatggattctaggtgggaagaaacaaaacaaccttgtaaatcaaatgagcatcgtttgaaagctataagttgtataaagctgttttaggaccaagaaagggggctaaccaggaaaaccaggaccagttgttaaatttccaccagtcaaagcctcctgaaactctgttttccattaacttgttggccctgtctgtaatttttttaagttggtttgcactttacctgattggttgatgaaaacagcaatgtttatcaagtgttgcacaagctcccccttgattggctgtgagcaaattaaaagctcatcaatttcataagactatgcttgctaatgaagcaatttgttctgaaagggtattgacctggttagttagattaataatttgttgagtaatttttaagaagagtttctgggcagtaaaaatggagttaaggaggtcctccagttcccgtgccaataccagccagaacgccaattatagtcagtgctgttaaaactcctctttcagttttaccagattgagcgtgtatagggaggggaatgctatcgataagagtgagtttggggatgatgtaaactagggccaaatccccgtttaattagcagacaagcagagatatgccttgtttctatacaaaaatgtgatttgtcatgttaagacaaatatcaacagtgatactaaagtagggtttttccatgctgtgtaagtctgctttaataccctcagaagtggaagtcaaggctagttcatgtaatgggggaacacaggcagtacttgacagaatgaaagaggaatcaaaagcccaattagaggaaggagtgatgggatcccaaccaatattgtgaaattatggggagctgcagttttttgcaatgattttgcccgaagttgtgagactgaaaccagaagttgttatgtttaaaatgatattctggtgtgggtctggggaaaagggtagatccagaatagctggcttctttccacatagtggttctgttggggggcttgggaaatgaataaaacacaaagaagaattagaatatcaggtgaaggtagcaggtgctcctggcagaagaacccacataaggaagtgtccagaagccacacagggtatatctcagagactggagaacgtgtctggttattatgcagatgcacggctggaggtgggatccacacagctcagaacagctggatcttgctcacactctttcaagagaagcttccttgaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggaggagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaa

SEQ ID NO: 436806 - DNA, 2118 bp, Homo sapiens
agcaggagggtgggaccaagggtgctgctggaccaaggatgggactgggccaagggtggggctgggaagcatcctgttttgcatgtttgatcaggagctgctgccaagttgtgactttcactttcccttttgggttccagggtatatctcagagactggagaacgtgtctggttattatgcagatgcacggctggaggtgggatccacacagctcagaacagctggatcttgctcacactctttcaagagaagcttccttgaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggaggagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaa

SEQ ID NO: 436807 - DNA, 3670 bp, Homo sapiens
actctggggaaaggagggtacaaccacatgtaaattttattataatgatggtataatgaacttggggtgacctgagggcatgtttttgtgttactgggcatgtgcccctttaggagacttccacctgtgccttactttctctttctttgggatgtgctggccacagactttaccaaaaactccatccattaggatggcattaggacggttctggggctaaacttaggtgggccaggggctgtttcactgtcagcctttctactctcttttcttacccactcctagctgctaatgtctatttaactacctaatatttccccctttagagaaaaaaagccaaatttttgggtagatcggtgacaattaatctggctacttcctgctgacaagaggcagtggtaataattgggttctcttttttgctctcttgtagctggtaggttgggcagagaaaagtggtggccatccaaggggcccacgtagatatcagacatggttgagacctcgcggtaaccttgtgtagaatcatttggagttttatggattctaggtgggaagaaacaaaacaaccttgtaaatcaaatgagcatcgtttgaaagctataagttgtataaagctgttttaggaccaagaaagggggctaaccaggaaaaccaggaccagttgttaaatttccaccagtcaaagcctcctgaaactctgttttccattaacttgttggccctgtctgtaatttttttaagttggtttgcactttacctgattggttgatgaaaacagcaatgtttatcaagtgttgcacaagctcccccttgattggctgtgagcaaattaaaagctcatcaatttcataagactatgcttgctaatgaagcaatttttaagaagagtttctgggcagtaaaaatggagttaaggaggtcctccagttcccgtgccaataccagccagaacgccaattatagtcagtgctgttaaaactcctctttcagttttaccagattgagcgtgtatagggaggggaatgctatcgataagagtgagtttggggatgatgtaaactagggccaaatccccgtttaattagcagacaagcagagatatgccttgtttctatacaaaaatgtgatttgtcatgttaagacaaatatcaacagtgatactaaagtagggtttttccatgctgtgtaagtctgctttaataccctcagaagtggaagtcaaggctagttcatgtaatgggggaacacaggcagtacttgacagaatgaaagaggaatcaaaagcccaattagaggaaggagtgatgggatcccaaccaatattgtgaaattatggggagctgcagttttttgcaatgattttgcccgaagttgtgagactgaaaccagaagttgttatgtttaaaatgatattctggtgtgggtctggggaaaagggtagatccagaatagctggcttctttccacatagtggttctgttggggggcttgggaaatgaataaaacacaaagaagaattagaatatcaggtgaaggtagcaggtgctcctggcagaagaacccacataaggaagtgtccagaagccacacagggtatatctcagagactggagaacgtgtctggttattatgcagatgcacggctggaggtgggatccacacagctcagaacagctggatcttgctcacactctttcaagagaagcttccttgggttaagaaaaaaaacgaacccttccagtcaggtcagtgactggagagctccaaggaaagtctctcagtgacctggctgctggcaccatggactcagaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggaggagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaa

SEQ ID NO: 436808 - DNA, 3726 bp, Homo sapiens
  misc_feature (3410)..(3411): n is a, c, g, or t
  misc_feature (3713)..(3713): n is a, c, g, or t
actctggggaaaggagggtacaaccacatgtaaattttattataatgatggtataatgaacttggggtgacctgagggcatgtttttgtgttactgggcatgtgcccctttaggagacttccacctgtgccttactttctctttctttgggatgtgctggccacagactttaccaaaaactccatccattaggatggcattaggacggttctggggctaaacttaggtgggccaggggctgtttcactgtcagcctttctactctcttttcttacccactcctagctgctaatgtctatttaactacctaatatttccccctttagagaaaaaaagccaaatttttgggtagatcggtgacaattaatctggctacttcctgctgacaagaggcagtggtaataattgggttctcttttttgctctcttgtagctggtaggttgggcagagaaaagtggtggccatccaaggggcccacgtagatatcagacatggttgagacctcgcggtaaccttgtgtagaatcatttggagttttatggattctaggtgggaagaaacaaaacaaccttgtaaatcaaatgagcatcgtttgaaagctataagttgtataaagctgttttaggaccaagaaagggggctaaccaggaaaaccaggaccagttgttaaatttccaccagtcaaagcctcctgaaactctgttttccattaacttgttggccctgtctgtaatttttttaagttggtttgcactttacctgattggttgatgaaaacagcaatgtttatcaagtgttgcacaagctcccccttgattggctgtgagcaaattaaaagctcatcaatttcataagactatgcttgctaatgaagcaatttttaagaagagtttctgggcagtaaaaatggagttaaggaggtcctccagttcccgtgccaataccagccagaacgccaattatagtcagtgctgttaaaactcctctttcagttttaccagattgagcgtgtatagggaggggaatgctatcgataagagtgagtttggggatgatgtaaactagggccaaatccccgtttaattagcagacaagcagagatatgccttgtttctatacaaaaatgtgatttgtcatgttaagacaaatatcaacagtgatactaaagtagggtttttccatgctgtgtaagtctgctttaataccctcagaagtggaagtcaaggctagttcatgtaatgggggaacacaggcagtacttgacagaatgaaagaggaatcaaaagcccaattagaggaaggagtgatgggatcccaaccaatattgtgaaattatggggagctgcagttttttgcaatgattttgcccgaagttgtgagactgaaaccagaagttgttatgtttaaaatgatattctggtgtgggtctggggaaaagggtagatccagaatagctggcttctttccacatagtggttctgttggggggcttgggaaatgaataaaacacaaagaagaattagaatatcaggtgaaggtagcaggtgctcctggcagaagaacccacataaggaagtgtccagaagccacacagggtatatctcagagactggagaacgtgtctggttattatgcagatgcacggctggaggtgggatccacacagctcagaacagctggatcttgctcacactctttcaagagaagcttccttgggttaagaaaaaaaacgaacccttccagtcaggtcagtgactggagagctccaaggaaagtctctcagtgacctggctgctggcaccatggactcagaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggaggagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgnntggggcccagctttctgtacaaaccccaacttcctggaccggttgcttacaacctccaagacagtctattacctcttatacagcccgcacagtgacctatactttacttctatcgtaccttgatgttgcgggccggcatctcctcttctctctttcctgagccaccctcccggccacatatctaatacactcacccctctcactctctccccactatcgccctcttatttctccttccgttctctctgtctccctcttccacccttctttctctctttcactcctttctcctcgcctctttnctcctccccctcc

SEQ ID NO: 436809 - DNA, 3186 bp, Homo sapiens
actctggggaaaggagggtacaaccacatgtaaattttattataatgatggtataatgaacttggggtgacctgagggcatgtttttgtgttactgggcatgtgcccctttaggagacttccacctgtgccttactttctctttctttgggatgtgctggccacagactttaccaaaaactccatccattaggatggcattaggacggttctggggctaaacttaggtgggccaggggctgtttcactgtcagcctttctactctcttttcttacccactcctagctgctaatgtctatttaactacctaatatttccccctttagagaaaaaaagccaaatttttgggtagatcggtgacaattaatctggctacttcctgctgacaagaggcagtggtaataattgggttctcttttttgctctcttgtagctggtaggttgggcagagaaaagtggtggccatccaaggggcccacgtagatatcagacatggttgagacctcgcggtaaccttgtgtagaatcatttggagttttatggattctaggtgggaagaaacaaaacaaccttgtaaatcaaatgagcatcgtttgaaagctataagttgtataaagctgttttaggaccaagaaagggggctaaccaggaaaaccaggaccagttgttaaatttccaccagtcaaagcctcctgaaactctgttttccattaacttgttggccctgtctgtaatttttttaagttggtttgcactttacctgattggttgatgaaaacagcaatgtttatcaagtgttgcacaagctcccccttgattggctgtgagcaaattaaaagctcatcaatttcataagactatgcttgctaatgaagcaatttttaagaagagtttctgggcagtaaaaatggagttaaggaggtcctccagttcccgtgccaataccagccagaacgccaattatagtcagtgctgttaaaactcctctttcagttttaccagattgagcgtgtatagggaggggaatgctatcgataagagtgagtttggggatgatgtaaactagggccaaatccccgtttaattagcagacaagcagagatatgccttgtttctatacaaaaatgtgatttgtcatgttaagacaaatatcaacagtgatactaaagtagggtttttccatgctgtgtaagtctgctttaataccctcagaagtggaagtcaaggctagttcatgtaatgggggaacacaggcagtacttgacagaatgaaagaggaatcaaaagcccaattagaggaaggagtgatgggatcccaaccaatattgtgaaattatggggagctgcagttttttgcaatgattttgcccgaagttgtgagactgaaaccagaagttgttatgtttaaaatgatattctggtgtgggtctggggaaaagggtagatccagaatagctggcttctttccacatagtggttctgttggggggcttgggaaatgaataaaacacaaagaagaattagaatatcaggtgaaggtagcaggtgctcctggcagaagaacccacataaggaagtgtccagaagccacacagggtatatctcagagactggagaacgtgtctggttattatgcagatgcacggctggaggtgggatccacacagctcagaacagctggatcttgctcacactctttcaagagaagcttccttgggttaagaaaaaaaacgaacccttccagtcaggtcagtgactggagagctccaaggaaagtctctcagtgacctggctgctggcaccatggactcagaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggaggagaggggactggagagtgtggggaataggaagaagaaatttcctttagactaacgaatatattggggggaggaatagaggggaggtgtgcaggaaccaagtgggaggccagcaaccaagtgggaggccagcaaccaagtgggaggccagcaaccaagtgggaggcca

SEQ ID NO: 436810 - DNA, 669 bp, Homo sapiens
gatccggtgggttctggctaacagaagagcacataggtgcgtcatataggtgccccctatggccaactgagggtaccagatgtggtgatgaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaa

SEQ ID NO: 436811 - DNA, 2444 bp, Homo sapiens
agcaggagggtgggaccaagggtgctgctggaccaaggatgggactgggccaagggtggggctgggaagcatcctgttttgcatgtttgatcaggagctgctgccaagttgtgactttcactttcccttttgggttccagggtatatctcagagactggagaacgtgtctggttattatgcagatgcacggctggaggtgggatccacacagctcagaacagctggatcttgctcacactctttcaagagaagcttccttggacaaaaggaccctgccttggtgtgagagtgagggcagagggagctggagcaagtagaatttctctaaataccagctggctggggcccaggagattaaaaaacaccgggctaggttggtcttggcatttgctgacacgcaaagggattgcagagatccagcccctccaacctccctctgtccacaggtggctcacattcagtcccacaatttgctttctcctcctcaagggttaagaaaaaaaacgaacccttccagtcaggtcagtgactggagagctccaaggaaagtctctcagtgacctggctgctggcaccatggactcagaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggaggagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaa

SEQ ID NO: 436812 - DNA, 3564 bp, Homo sapiens
actctggggaaaggagggtacaaccacatgtaaattttattataatgatggtataatgaacttggggtgacctgagggcatgtttttgtgttactgggcatgtgcccctttaggagacttccacctgtgccttactttctctttctttgggatgtgctggccacagactttaccaaaaactccatccattaggatggcattaggacggttctggggctaaacttaggtgggccaggggctgtttcactgtcagcctttctactctcttttcttacccactcctagctgctaatgtctatttaactacctaatatttccccctttagagaaaaaaagccaaatttttgggtagatcggtgacaattaatctggctacttcctgctgacaagaggcagtggtaataattgggttctcttttttgctctcttgtagctggtaggttgggcagagaaaagtggtggccatccaaggggcccacgtagatatcagacatggttgagacctcgcggtaaccttgtgtagaatcatttggagttttatggattctaggtgggaagaaacaaaacaaccttgtaaatcaaatgagcatcgtttgaaagctataagttgtataaagctgttttaggaccaagaaagggggctaaccaggaaaaccaggaccagttgttaaatttccaccagtcaaagcctcctgaaactctgttttccattaacttgttggccctgtctgtaatttttttaagttggtttgcactttacctgattggttgatgaaaacagcaatgtttatcaagtgttgcacaagctcccccttgattggctgtgagcaaattaaaagctcatcaatttcataagactatgcttgctaatgaagcaatttgttctgaaagggtattgacctggttagttagattaataatttgttgagtaatttttaagaagagtttctgggcagtaaaaatggagttaaggaggtcctccagttcccgtgccaataccagccagaacgccaattatagtcagtgctgttaaaactcctctttcagttttaccagattgagcgtgtatagggaggggaatgctatcgataagagtgagtttggggatgatgtaaactagggccaaatccccgtttaattagcagacaagcagagatatgccttgtttctatacaaaaatgtgatttgtcatgttaagacaaatatcaacagtgatactaaagtagggtttttccatgctgtgtaagtctgctttaataccctcagaagtggaagtcaaggctagttcatgtaatgggggaacacaggcagtacttgacagaatgaaagaggaatcaaaagcccaattagaggaaggagtgatgggatcccaaccaatattgtgaaattatggggagctgcagttttttgcaatgattttgcccgaagttgtgagactgaaaccagaagttgttatgtttaaaatgatattctggtgtgggtctggggaaaagggtagatccagaatagctggcttctttccacatagtggttctgttggggggcttgggaaatgaataaaacacaaagaagaattagaatatcagggtatatctcagagactggagaacgtgtctggttattatgcagatgcacggctggaggtgggatccacacagctcagaacagctggatcttgctcacactctttcaagagaagcttccttgaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggaggagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaa

SEQ ID NO: 436813 - DNA, 2328 bp, Homo sapiens
agcaggagggtgggaccaagggtgctgctggaccaaggatgggactgggccaagggtggggctgggaagcatcctgttttgcatgtttgatcaggagctgctgccaagttgtgactttcactttcccttttgggttccagggtatatctcagagactggagaacgtgtctggttattatgcagatgcacggctggaggtgggatccacacagctcagaacagctggatcttgctcacactctttcaagagaagcttccttggacaaaaggaccctgccttggtgtgagagtgagggcagagggagctggagcaagtagaatttctctaaataccagctggctggggcccaggagattaaaaaacaccgggctagggttaagaaaaaaaacgaacccttccagtcaggtcagtgactggagagctccaaggaaagtctctcagtgacctggctgctggcaccatggactcagaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggaggagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaa

SEQ ID NO: 436814 - DNA, 3873 bp, Homo sapiens
actctggggaaaggagggtacaaccacatgtaaattttattataatgatggtataatgaacttggggtgacctgagggcatgtttttgtgttactgggcatgtgcccctttaggagacttccacctgtgccttactttctctttctttgggatgtgctggccacagactttaccaaaaactccatccattaggatggcattaggacggttctggggctaaacttaggtgggccaggggctgtttcactgtcagcctttctactctcttttcttacccactcctagctgctaatgtctatttaactacctaatatttccccctttagagaaaaaaagccaaatttttgggtagatcggtgacaattaatctggctacttcctgctgacaagaggcagtggtaataattgggttctcttttttgctctcttgtagctggtaggttgggcagagaaaagtggtggccatccaaggggcccacgtagatatcagacatggttgagacctcgcggtaaccttgtgtagaatcatttggagttttatggattctaggtgggaagaaacaaaacaaccttgtaaatcaaatgagcatcgtttgaaagctataagttgtataaagctgttttaggaccaagaaagggggctaaccaggaaaaccaggaccagttgttaaatttccaccagtcaaagcctcctgaaactctgttttccattaacttgttggccctgtctgtaatttttttaagttggtttgcactttacctgattggttgatgaaaacagcaatgtttatcaagtgttgcacaagctcccccttgattggctgtgagcaaattaaaagctcatcaatttcataagactatgcttgctaatgaagcaatttttaagaagagtttctgggcagtaaaaatggagttaaggaggtcctccagttcccgtgccaataccagccagaacgccaattatagtcagtgctgttaaaactcctctttcagttttaccagattgagcgtgtatagggaggggaatgctatcgataagagtgagtttggggatgatgtaaactagggccaaatccccgtttaattagcagacaagcagagatatgccttgtttctatacaaaaatgtgatttgtcatgttaagacaaatatcaacagtgatactaaagtagggtttttccatgctgtgtaagtctgctttaataccctcagaagtggaagtcaaggctagttcatgtaatgggggaacacaggcagtacttgacagaatgaaagaggaatcaaaagcccaattagaggaaggagtgatgggatcccaaccaatattgtgaaattatggggagctgcagttttttgcaatgattttgcccgaagttgtgagactgaaaccagaagttgttatgtttaaaatgatattctggtgtgggtctggggaaaagggtagatccagaatagctggcttctttccacatagtggttctgttggggggcttgggaaatgaataaaacacaaagaagaattagaatatcaggtgaaggtagcaggtgctcctggcagaagaacccacataaggaagtgtccagaagccacacagggtatatctcagagactggagaacgtgtctggttattatgcagatgcacggctggaggtgggatccacacagctcagaacagctggatcttgctcacactctttcaagagaagcttccttgggttaagaaaaaaaacgaacccttccagtcaggtcagtgactggagagctccaaggaaagtctctcagtgacctggctgctggcaccatggactcagaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggaggagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaaactggacttattcgagtcattccttggtctcctggctcctttctcgctttgggagcaagttcctgtctgaagtttttgtctgaacagtggtaaaggtgatggtgatgatgtcagcagacagcaggaggacttgacaaatgtcagccctgcttggggccaggatacactgagggaacgatgacattccaatgaaactccaaatt

SEQ ID NO: 436815 - DNA, 3394 bp, Homo sapiens
actctggggaaaggagggtacaaccacatgtaaattttattataatgatggtataatgaacttggggtgacctgagggcatgtttttgtgttactgggcatgtgcccctttaggagacttccacctgtgccttactttctctttctttgggatgtgctggccacagactttaccaaaaactccatccattaggatggcattaggacggttctggggctaaacttaggtgggccaggggctgtttcactgtcagcctttctactctcttttcttacccactcctagctgctaatgtctatttaactacctaatatttccccctttagagaaaaaaagccaaatttttgggtagatcggtgacaattaatctggctacttcctgctgacaagaggcagtggtaataattgggttctcttttttgctctcttgtagctggtaggttgggcagagaaaagtggtggccatccaaggggcccacgtagatatcagacatggttgagacctcgcggtaaccttgtgtagaatcatttggagttttatggattctaggtgggaagaaacaaaacaaccttgtaaatcaaatgagcatcgtttgaaagctataagttgtataaagctgttttaggaccaagaaagggggctaaccaggaaaaccaggaccagttgttaaatttccaccagtcaaagcctcctgaaactctgttttccattaacttgttggccctgtctgtaatttttttaagttggtttgcactttacctgattggttgatgaaaacagcaatgtttatcaagtgttgcacaagctcccccttgattggctgtgagcaaattaaaagctcatcaatttcataagactatgcttgctaatgaagcaatttttaagaagagtttctgggcagtaaaaatggagttaaggaggtcctccagttcccgtgccaataccagccagaacgccaattatagtcagtgctgttaaaactcctctttcagttttaccagattgagcgtgtatagggaggggaatgctatcgataagagtgagtttggggatgatgtaaactagggccaaatccccgtttaattagcagacaagcagagatatgccttgtttctatacaaaaatgtgatttgtcatgttaagacaaatatcaacagtgatactaaagtagggtttttccatgctgtgtaagtctgctttaataccctcagaagtggaagtcaaggctagttcatgtaatgggggaacacaggcagtacttgacagaatgaaagaggaatcaaaagcccaattagaggaaggagtgatgggatcccaaccaatattgtgaaattatggggagctgcagttttttgcaatgattttgcccgaagttgtgagactgaaaccagaagttgttatgtttaaaatgatattctggtgtgggtctggggaaaagggtagatccagaatagctggcttctttccacatagtggttctgttggggggcttgggaaatgaataaaacacaaagaagaattagaatatcaggtgaaggtagcaggtgctcctggcagaagaacccacataaggaagtgtccagaagccacacagggtatatctcagagactggagaacgtgtctggttattatgcagatgcacggctggaggtgggatccacacagctcagaacagctggatcttgctcacactctttcaagagaagcttccttgggttaagaaaaaaaacgaacccttccagtcaggtcagtgactggagagctccaaggaaagtctctcagtgacctggctgctggcaccatggactcagaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcacatagattaagggatttggcttccttctgaactagatcatttgttagaggcttcagaaaaagaaaattagcttgaaatctagtctgggaaatggggggcagggaatgaaaaagttggtctcttgtttctccacgatacacaggcttcccatctaaagtcatgcttaactaaaagggaaaaaaaatgaaccaagcaaaagtatatagagtagccgtgacatttgcattattttctagactttacatttgcctgcaacaggcataacatgaaactccagagggaattgggatggataggaatgttcacataaacaccagcagtggctaactgttacacaacattcaaagtattcgagagaactgcctggagacagagagcgagggtccacagacacattagcaccatactgatgggagc

SEQ ID NO: 436816 - DNA, 2636 bp, Homo sapiens
cgcctagccgcgccggtcccagaagtggcgaaagccgcagccgagtccaggtcacgccgaagccgttgcccttttaagggggagccttgaaacggcgcctgggttccatgtttgcatccgcctcgcgggaaggaaactccatgttgtaacaaagtttcctccgcgccccctccctccccctcccccctagaacctggctcccctcccctccggagctcgcggggatccctccctcccacccctcccctcccccccgcgccccgattccggccccagccgggggggaggccgggcgcccgggccagagtccggccggagcggagcgcgcccggccccatggacagctcggccgtcattactcagatcagcaaggaggaggctcggggcccgctgcggggcaaaggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctacagaccccagtccaatacctgctccctgaggccaaggcccaggactcagacaagatctgcgtggtcatcgacctggacgagaccctggtgcacagctccttcaagccagtgaacaacgcggacttcatcatccctgtggagattgatggggtggtccaccaggtctacgtgttgaagcgtcctcatgtggatgagttcctgcagcgaatgggcgagctctttgaatgtgtgctgttcactgctagcctcgccaagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggccctgcctgctgctccctttttctgtctctgtccatgctgccatgtttctctgctgccaaattgggccccttggccccttccggttctgcttcctgggggcagggttcctgccttggacccccagtctgggaacggtggacatcaagtgccttgcatagagccccctcttccccgcccagctttcccaggggcacagctctaggctgggaggggagaaccagcccctccccctgccccacctcctcccttgggactgagagggcccctaccaacctttgcctctgccttggagggaggggaggtctgttaccactggggaaggcagcaggagtctgtccttcaggccccacagtgcagcttctccagggccgacagctgagggctgctccctgcatcatccaagcaatgacctcagacttctgccttaaccagccccggggcttggctcccccagctctgagcgtgggggcataggcaggaccccccttgtggtgccatataaatatgtacatgtgtatatagatttttaggggaaggagagagggaagggtcagggtagagacacccctcccttgcccctttcctgggcccagaagttggggggagggagggaaaggatttttacattttttaaactgctattttctgaatggaacaagctgggccaaggggcccaggccctgtcctctgtccctcacacccctttgctccgttcattcattcaaaaaaacatttcttgagcaccttctgtgcccagcatatgctaggcccaccagctaagtgtgtgtggggggtctctacgccagctcatcagtgcctccttgcccatccttcaccggtgcctttgggggatctgtaggaggtgggaccttctgtggggtttggggatctccaggaagcccgaccaagctgtccccttcccctgtgccaacccatctcctacagccccctgcctgatcccctgctggctgggggcagctcccaggatatcctgccttccaactgtttctgaagcccctcctcctaacatggcgattccggaggtcaaggccttgggctctccccagggtctaacggttaaggggacccacataccagtgccaagggggatgtcaagtggtgatgtcgttgtgctcccctcccccagagcgggtgggcggggggtgaatatggttggcctgcatcaggtggccttcccatttaagtgccttctctgtgactgagagccctagtgtgatgagaactaaagagaaagccagaccccta

SEQ ID NO: 436817 - DNA, 3023 bp, Homo sapiens
cttcttgtttgctcgtccttcccctccctcgtcctccgtctgtgtgcggtcgcctgtcgtttcttcttccgtctctctttctgtcttcggcgctttctctcccctctttcgtccctcccgtctattcttcttcctgtcacacacacgctctgcctgtctctctctctctgctcctccgccccccgccttgcgtccccttttctctccttctcgccccccgcgcgcccccgcggtgtgtcgttcttttttttctttctatatatataatacttgttttattttttttttttttttttttttatttatttttttatttttttttttttttgttttttattattttttattatatatttgtattttttattttttattttattttttttttttttttttttgtttgtcgggcttggcattattaatttttaaatggtgaacttacaaaatagtaacgacgagtgaaaagaacttcataaacgaggaaaaagaccaacccgcagacccacggcgcgcaccacggaggggcttgcagcgagaagacagggacctccgttcccaagtgcccagcactgcgccacaggccgggtggaacgggccttgagggcctctggtttgaggtcccccacggtcgggctttgggcccaccgcgtgcggcgccgtgctgggctcctaggatcggcagcgagtccagtgactcccaccgcacccccagtaatcacagggcggccggcgaccgcgggcaggggagggggtctgggaaggcccctggagaaggtggcatttcctcgaggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctacagaccccagtccaatacctgctccctgaggccaaggcccaggactcagacaagatctgcgtggtcatcgacctggacgagaccctggtgcacagctccttcaagccagtgaacaacgcggacttcatcatccctgtggagattgatggggtggtccaccaggtctacgtgttgaagcgtcctcatgtggatgagttcctgcagcgaatgggcgagctctttgaatgtgtgctgttcactgctagcctcgccaagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggccctgcctgctgctccctttttctgtctctgtccatgctgccatgtttctctgctgccaaattgggccccttggccccttccggttctgcttcctgggggcagggttcctgccttggacccccagtctgggaacggtggacatcaagtgccttgcatagagccccctcttccccgcccagctttcccaggggcacagctctaggctgggaggggagaaccagcccctccccctgccccacctcctcccttgggactgagagggcccctaccaacctttgcctctgccttggagggaggggaggtctgttaccactggggaaggcagcaggagtctgtccttcaggccccacagtgcagcttctccagggccgacagctgagggctgctccctgcatcatccaagcaatgacctcagacttctgccttaaccagccccggggcttggctcccccagctctgagcgtgggggcataggcaggaccccccttgtggtgccatataaatatgtacatgtgtatatagatttttaggggaaggagagagggaagggtcagggtagagacacccctcccttgcccctttcctgggcccagaagttggggggagggagggaaaggatttttacattttttaaactgctattttctgaatggaacaagctgggccaaggggcccaggccctgtcctctgtccctcacacccctttgctccgttcattcattcaaaaaaacatttcttgagcaccttctgtgcccagcatatgctaggcccaccagctaagtgtgtgtggggggtctctacgccagctcatcagtgcctccttgcccatccttcaccggtgcctttgggggatctgtaggaggtgggaccttctgtggggtttggggatctccaggaagcccgaccaagctgtccccttcccctgtgccaacccatctcctacagccccctgcctgatcccctgctggctgggggcagctcccaggatatcctgccttccaactgtttctgaagcccctcctcctaacatggcgattccggaggtcaaggccttgggctctccccagggtctaacggttaaggggacccacataccagtgccaagggggatgtcaagtggtgatgtcgttgtgctcccctcccccagagcgggtgggcggggggtgaatatggttggcctgcatcaggtggccttcccatttaagtgccttctctgtgactgagagccctagtgtgatgagaactaaagagaaagccagaccccta

SEQ ID NO: 436818 - DNA, 2358 bp, Homo sapiens
cggccgccttagctgtgcccgaagctcccagcccgagagggagcagggagagagtttgaactcagaggaggctcagagacgcggggcggggcctggcgcctttggggcgctcctgtccgctcgaggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctacagaccccagtccaatacctgctccctgaggccaaggcccaggactcagacaagatctgcgtggtcatcgacctggacgagaccctggtgcacagctccttcaagccagtgaacaacgcggacttcatcatccctgtggagattgatggggtggtccaccaggtctacgtgttgaagcgtcctcatgtggatgagttcctgcagcgaatgggcgagctctttgaatgtgtgctgttcactgctagcctcgccaagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggccctgcctgctgctccctttttctgtctctgtccatgctgccatgtttctctgctgccaaattgggccccttggccccttccggttctgcttcctgggggcagggttcctgccttggacccccagtctgggaacggtggacatcaagtgccttgcatagagccccctcttccccgcccagctttcccaggggcacagctctaggctgggaggggagaaccagcccctccccctgccccacctcctcccttgggactgagagggcccctaccaacctttgcctctgccttggagggaggggaggtctgttaccactggggaaggcagcaggagtctgtccttcaggccccacagtgcagcttctccagggccgacagctgagggctgctccctgcatcatccaagcaatgacctcagacttctgccttaaccagccccggggcttggctcccccagctctgagcgtgggggcataggcaggaccccccttgtggtgccatataaatatgtacatgtgtatatagatttttaggggaaggagagagggaagggtcagggtagagacacccctcccttgcccctttcctgggcccagaagttggggggagggagggaaaggatttttacattttttaaactgctattttctgaatggaacaagctgggccaaggggcccaggccctgtcctctgtccctcacacccctttgctccgttcattcattcaaaaaaacatttcttgagcaccttctgtgcccagcatatgctaggcccaccagctaagtgtgtgtggggggtctctacgccagctcatcagtgcctccttgcccatccttcaccggtgcctttgggggatctgtaggaggtgggaccttctgtggggtttggggatctccaggaagcccgaccaagctgtccccttcccctgtgccaacccatctcctacagccccctgcctgatcccctgctggctgggggcagctcccaggatatcctgccttccaactgtttctgaagcccctcctcctaacatggcgattccggaggtcaaggccttgggctctccccagggtctaacggttaaggggacccacataccagtgccaagggggatgtcaagtggtgatgtcgttgtgctcccctcccccagagcgggtgggcggggggtgaatatggttggcctgcatcaggtggccttcccatttaagtgccttctctgtgactgagagccctagtgtgatgagaactaaagagaaagccagaccccta

SEQ ID NO: 436819 - DNA, 2311 bp, Homo sapiens
ccgaagcacgtcgcttcctttcttgaaactcagtttcctcatctgtgaaatgggttaagaaggaggccgttctaaggggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctacagaccccagtccaatacctgctccctgaggccaaggcccaggactcagacaagatctgcgtggtcatcgacctggacgagaccctggtgcacagctccttcaagccagtgaacaacgcggacttcatcatccctgtggagattgatggggtggtccaccaggtctacgtgttgaagcgtcctcatgtggatgagttcctgcagcgaatgggcgagctctttgaatgtgtgctgttcactgctagcctcgccaagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggccctgcctgctgctccctttttctgtctctgtccatgctgccatgtttctctgctgccaaattgggccccttggccccttccggttctgcttcctgggggcagggttcctgccttggacccccagtctgggaacggtggacatcaagtgccttgcatagagccccctcttccccgcccagctttcccaggggcacagctctaggctgggaggggagaaccagcccctccccctgccccacctcctcccttgggactgagagggcccctaccaacctttgcctctgccttggagggaggggaggtctgttaccactggggaaggcagcaggagtctgtccttcaggccccacagtgcagcttctccagggccgacagctgagggctgctccctgcatcatccaagcaatgacctcagacttctgccttaaccagccccggggcttggctcccccagctctgagcgtgggggcataggcaggaccccccttgtggtgccatataaatatgtacatgtgtatatagatttttaggggaaggagagagggaagggtcagggtagagacacccctcccttgcccctttcctgggcccagaagttggggggagggagggaaaggatttttacattttttaaactgctattttctgaatggaacaagctgggccaaggggcccaggccctgtcctctgtccctcacacccctttgctccgttcattcattcaaaaaaacatttcttgagcaccttctgtgcccagcatatgctaggcccaccagctaagtgtgtgtggggggtctctacgccagctcatcagtgcctccttgcccatccttcaccggtgcctttgggggatctgtaggaggtgggaccttctgtggggtttggggatctccaggaagcccgaccaagctgtccccttcccctgtgccaacccatctcctacagccccctgcctgatcccctgctggctgggggcagctcccaggatatcctgccttccaactgtttctgaagcccctcctcctaacatggcgattccggaggtcaaggccttgggctctccccagggtctaacggttaaggggacccacataccagtgccaagggggatgtcaagtggtgatgtcgttgtgctcccctcccccagagcgggtgggcggggggtgaatatggttggcctgcatcaggtggccttcccatttaagtgccttctctgtgactgagagccctagtgtgatgagaactaaagagaaagccagaccccta

SEQ ID NO: 436820 - DNA, 2660 bp, Homo sapiens
cgcctagccgcgccggtcccagaagtggcgaaagccgcagccgagtccaggtcacgccgaagccgttgcccttttaagggggagccttgaaacggcgcctgggttccatgtttgcatccgcctcgcgggaaggaaactccatgttgtaacaaagtttcctccgcgccccctccctccccctcccccctagaacctggctcccctcccctccggagctcgcggggatccctccctcccacccctcccctcccccccgcgccccgattccggccccagccgggggggaggccgggcgcccgggccagagtccggccggagcggagcgcgcccggccccatggacagctcggccgtcattactcagatcagcaaggaggaggctcggggcccgctgcggggcaaaggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctacagaccccagtccaatacctgctccctgaggccaaggcccaggactcagacaagatctgcgtggtcatcgacctggacgagaccctggtgcacagctccttcaagccagtgaacaacgcggacttcatcatccctgtggagattgatggggtggtccaccagccccctcactggcccgccccccaggtctacgtgttgaagcgtcctcatgtggatgagttcctgcagcgaatgggcgagctctttgaatgtgtgctgttcactgctagcctcgccaagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggccctgcctgctgctccctttttctgtctctgtccatgctgccatgtttctctgctgccaaattgggccccttggccccttccggttctgcttcctgggggcagggttcctgccttggacccccagtctgggaacggtggacatcaagtgccttgcatagagccccctcttccccgcccagctttcccaggggcacagctctaggctgggaggggagaaccagcccctccccctgccccacctcctcccttgggactgagagggcccctaccaacctttgcctctgccttggagggaggggaggtctgttaccactggggaaggcagcaggagtctgtccttcaggccccacagtgcagcttctccagggccgacagctgagggctgctccctgcatcatccaagcaatgacctcagacttctgccttaaccagccccggggcttggctcccccagctctgagcgtgggggcataggcaggaccccccttgtggtgccatataaatatgtacatgtgtatatagatttttaggggaaggagagagggaagggtcagggtagagacacccctcccttgcccctttcctgggcccagaagttggggggagggagggaaaggatttttacattttttaaactgctattttctgaatggaacaagctgggccaaggggcccaggccctgtcctctgtccctcacacccctttgctccgttcattcattcaaaaaaacatttcttgagcaccttctgtgcccagcatatgctaggcccaccagctaagtgtgtgtggggggtctctacgccagctcatcagtgcctccttgcccatccttcaccggtgcctttgggggatctgtaggaggtgggaccttctgtggggtttggggatctccaggaagcccgaccaagctgtccccttcccctgtgccaacccatctcctacagccccctgcctgatcccctgctggctgggggcagctcccaggatatcctgccttccaactgtttctgaagcccctcctcctaacatggcgattccggaggtcaaggccttgggctctccccagggtctaacggttaaggggacccacataccagtgccaagggggatgtcaagtggtgatgtcgttgtgctcccctcccccagagcgggtgggcggggggtgaatatggttggcctgcatcaggtggccttcccatttaagtgccttctctgtgactgagagccctagtgtgatgagaactaaagagaaagccagaccccta

SEQ ID NO: 436821 - DNA, 2660 bp, Homo sapiens
cggccgccttagctgtgcccgaagctcccagcccgagagggagcagggagagagtttgaactcagaggaggctcagagacgcggggcggggcctggcgcctttggggcgctcctgtccgctcgaggtgaggaaactgaggcaggaatagagagggaactccttcgggggtttcctggcaggcattgcgtggtgcatgggcgcccccccaccattggcgccaatggggctgggagatgggggagctgaggagggcgcctatgggccacccgtgagactccgccccaccccccacccccacccccccgggctgcggtccggtagggtcttgggagggggcgccgaggtgacagcaggctggggaggcttggagggatctcccgccaacacacagctacgttccccacaaacttcgcgtcacgcgtggaggcgccgaccccctcggaggcacagagaggacggccggcacttccaagagtcgcttggcgcccgcggggagagtcgtgcgcctagtgggcacgcaccaccccgcaaagcctcgccgccccgacgaggctgcgtcccccagcgtggctgggccggggtgggggggtctgtcttctccttttccccgtgtggacctcaggatctggacgctgcccccaggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctacagaccccagtccaatacctgctccctgaggccaaggcccaggactcagacaagatctgcgtggtcatcgacctggacgagaccctggtgcacagctccttcaagccagtgaacaacgcggacttcatcatccctgtggagattgatggggtggtccaccagctgcggcgggtgctcatcctggacaattcacctgcctcctatgtcttccatccagacaatgctgtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggccctgcctgctgctccctttttctgtctctgtccatgctgccatgtttctctgctgccaaattgggccccttggccccttccggttctgcttcctgggggcagggttcctgccttggacccccagtctgggaacggtggacatcaagtgccttgcatagagccccctcttccccgcccagctttcccaggggcacagctctaggctgggaggggagaaccagcccctccccctgccccacctcctcccttgggactgagagggcccctaccaacctttgcctctgccttggagggaggggaggtctgttaccactggggaaggcagcaggagtctgtccttcaggccccacagtgcagcttctccagggccgacagctgagggctgctccctgcatcatccaagcaatgacctcagacttctgccttaaccagccccggggcttggctcccccagctctgagcgtgggggcataggcaggaccccccttgtggtgccatataaatatgtacatgtgtatatagatttttaggggaaggagagagggaagggtcagggtagagacacccctcccttgcccctttcctgggcccagaagttggggggagggagggaaaggatttttacattttttaaactgctattttctgaatggaacaagctgggccaaggggcccaggccctgtcctctgtccctcacacccctttgctccgttcattcattcaaaaaaacatttcttgagcaccttctgtgcccagcatatgctaggcccaccagctaagtgtgtgtggggggtctctacgccagctcatcagtgcctccttgcccatccttcaccggtgcctttgggggatctgtaggaggtgggaccttctgtggggtttggggatctccaggaagcccgaccaagctgtccccttcccctgtgccaacccatctcctacagccccctgcctgatcccctgctggctgggggcagctcccaggatatcctgccttccaactgtttctgaagcccctcctcctaacatggcgattccggaggtcaaggccttgggctctccccagggtctaacggttaaggggacccacataccagtgccaagggggatgtcaagtggtgatgtcgttgtgctcccctcccccagagcgggtgggcggggggtgaatatggttggcctgcatcaggtggccttcccatttaagtgccttctctgtgactgagagccctagtgtgatgagaactaaagagaaagccagaccccta

SEQ ID NO: 436822 - DNA, 2959 bp, Homo sapiens
  misc_feature (2934)..(2934): n is a, c, g, or t
  misc_feature (2959)..(2959): n is a, c, g, or t
cgcctagccgcgccggtcccagaagtggcgaaagccgcagccgagtccaggtcacgccgaagccgttgcccttttaagggggagccttgaaacggcgcctgggttccatgtttgcatccgcctcgcgggaaggaaactccatgttgtaacaaagtttcctccgcgccccctccctccccctcccccctagaacctggctcccctcccctccggagctcgcggggatccctccctcccacccctcccctcccccccgcgccccgattccggccccagccgggggggaggccgggcgcccgggccagagtccggccggagcggagcgcgcccggccccatggacagctcggccgtcattactcagatcagcaaggaggaggctcggggcccgctgcggggcaaaggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctacagaccccagtccaatacctgctccctgaggccaaggcccaggactcagacaagatctgcgtggtcatcgacctggacgagaccctggtgcacagctccttcaagccagtgaacaacgcggacttcatcatccctgtggagattgatggggtggtccaccaggtctacgtgttgaagcgtcctcatgtggatgagttcctgcagcgaatgggcgagctctttgaatgtgtgctgttcactgctagcctcgccaagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggccctgcctgctgctccctttttctgtctctgtccatgctgccatgtttctctgctgccaaattgggccccttggccccttccggttctgcttcctgggggcagggttcctgccttggacccccagtctgggaacggtggacatcaagtgccttgcatagagccccctcttccccgcccagctttcccaggggcacagctctaggctgggaggggagaaccagcccctccccctgccccacctcctcccttgggactgagagggcccctaccaacctttgcctctgccttggagggaggggaggtctgttaccactggggaaggcagcaggagtctgtccttcaggccccacagtgcagcttctccagggccgacagctgagggctgctccctgcatcatccaagcaatgacctcagacttctgccttaaccagccccggggcttggctcccccagctctgagcgtgggggcataggcaggaccccccttgtggtgccatataaatatgtacatgtgtatatagatttttaggggaaggagagagggaagggtcagggtagagacacccctcccttgcccctttcctgggcccagaagttggggggagggagggaaaggatttttacattttttaaactgctattttctgaatggaacaagctgggccaaggggcccaggccctgtcctctgtccctcacacccctttgctccgttcattcattcaaaaaaacatttcttgagcaccttctgtgcccagcatatgctaggcccaccagctaagtgtgtgtggggggtctctacgccagctcatcagtgcctccttgcccatccttcaccggtgcctttgggggatctgtaggaggtgggaccttctgtggggtttggggatctccaggaagcccgaccaagctgtccccttcccctgtgccaacccatctcctacagccccctgcctgatcccctgctggctgggggcagctcccaggatatcctgccttccaactgtttctgaagcccctcctcctaacatggcgattccggaggtcaaggccttgggctctccccagggtctaacggttaaggggacccacataccagtgccaagggggatgtcaagtggtgatgtcgttgtgctcccctcccccagagcgggtgggcggggggtgaatatggttggcctgcatcaggtggccttcccatttaagtgccttctctgtgactgagagccctagtgtgatgagaactaaagagaaagccagacccctaaaaaaaaaaaaaaacaaaaaaaaaaacaactttttgggccggccttgggccctctggaaaaagtttttaaacccctttctttgggcgccgcgggggccccatatgtgttacggtaacactgcgccatagcctggtcccaaagagagaaacccggggccataacaaaggtgtctggtttctcccccatttaaaaaaccgccgcgggcggaacccagaggctgtctaacaaattcccaatagggactccgagaggcactacacgggatctatacacccggaggcacacagcgacctccanttaaattagcgcgctccccgggcgn

SEQ ID NO: 436823 - DNA, 2644 bp, Homo sapiens
cgcctagccgcgccggtcccagaagtggcgaaagccgcagccgagtccaggtcacgccgaagccgttgcccttttaagggggagccttgaaacggcgcctgggttccatgtttgcatccgcctcgcgggaaggaaactccatgttgtaacaaagtttcctccgcgccccctccctccccctcccccctagaacctggctcccctcccctccggagctcgcggggatccctccctcccacccctcccctcccccccgcgccccgattccggccccagccgggggggaggccgggcgcccgggccagagtccggccggagcggagcgcgcccggccccatggacagctcggccgtcattactcagatcagcaaggaggaggctcggggcccgctgcggggcaaaggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctacagaccccagtccaatacctgctccctgaggccaaggcccaggactcagacaagatctgcgtggtcatcgacctggacgagaccctggtgcacagctccttcaagccagtgaacaacgcggacttcatcatccctgtggagattgatggggtggtccaccaggtctacgtgttgaagcgtcctcatgtggatgagttcctgcagcgaatgggcgagctctttgaatgtgtgctgttcactgctagcctcgccaagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggccctgcctgctgctccctttttctgtctctgtccatgctgccatgtttctctgctgccaaattgggccccttggccccttccggttctgcttcctgggggcagggttcctgccttggacccccagtctgggaacggtggacatcaagtgccttgcatagagccccctcttccccgcccagctttcccaggggcacagctctaggctgggaggggagaaccagcccctccccctgccccacctcctcccttgggactgagagggcccctaccaacctttgcctctgccttggagggaggggaggtctgttaccactggggaaggcagcaggagtctgtccttcaggccccacagtgcagcttctccagggccgacagctgagggctgctccctgcatcatccaagcaatgacctcagacttctgccttaaccagccccggggcttggctcccccagctctgagcgtgggggcataggcaggaccccccttgtggtgccatataaatatgtacatgtgtatatagatttttaggggaaggagagagggaagggtcagggtagagacacccctcccttgcccctttcctgggcccagaagttggggggagggagggaaaggatttttacattttttaaactgctattttctgaatggaacaagctgggccaaggggcccaggccctgtcctctgtccctcacacccctttgctccgttcattcattcaaaaaaacatttcttgagcaccttctgtgcccagcatatgctaggcccaccagctaagtgtgtgtggggggtctctacgccagctcatcagtgcctccttgcccatccttcaccggtgcctttgggggatctgtaggaggtgggaccttctgtggggtttggggatctccaggaagcccgaccaagctgtccccttcccctgtgccaacccatctcctacagccccctgcctgatcccctgctggctgggggcagctcccaggatatcctgccttccaactgtttctgaagcccctcctcctaacatggcgattccggaggtcaaggccttgggctctccccagggtctaacggttaaggggacccacataccagtgccaagggggatgtcaagtggtgatgtcgttgtgctcccctcccccagagcgggtgggcggggggtgaatatggttggcctgcatcagtgcaatcccagtagtgccattcttcctgctgacctgatacacaccctaggtgtgattgagaatcaaagaccgccctactcggtgttc

SEQ ID NO: 436824 - DNA, 2674 bp, Homo sapiens
cgcctagccgcgccggtcccagaagtggcgaaagccgcagccgagtccaggtcacgccgaagccgttgcccttttaagggggagccttgaaacggcgcctgggttccatgtttgcatccgcctcgcgggaaggaaactccatgttgtaacaaagtttcctccgcgccccctccctccccctcccccctagaacctggctcccctcccctccggagctcgcggggatccctccctcccacccctcccctcccccccgcgccccgattccggccccagccgggggggaggccgggcgcccgggccagagtccggccggagcggagcgcgcccggccccatggacagctcggccgtcattactcagatcagcaaggaggaggctcggggcccgctgcggggcaaaggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctacagaccccagtccaatacctgctccctgaggccaaggcccaggactcagacaagatctgcgtggtcatcgacctggacgagaccctggtgcacagctccttcaagccagtgaacaacgcggacttcatcatccctgtggagattgatggggtggtccaccaggtctacgtgttgaagcgtcctcatgtggatgagttcctgcagcgaatgggcgagctctttgaatgtgtgctgttcactgctagcctcgccaagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggccctgcctgctgctccctttttctgtctctgtccatgctgccatgtttctctgctgccaaattgggccccttggccccttccggttctgcttcctgggggcagggttcctgccttggacccccagtctgggaacggtggacatcaagtgccttgcatagagccccctcttccccgcccagctttcccaggggcacagctctaggctgggaggggagaaccagcccctccccctgccccacctcctcccttgggactgagagggcccctaccaacctttgcctctgccttggagggaggggaggtctgttaccactggggaaggcagcaggagtctgtccttcaggccccacagtgcagcttctccagggccgacagctgagggctgctccctgcatcatccaagcaatgacctcagacttctgccttaaccagccccggggcttggctcccccagctctgagcgtgggggcataggcaggaccccccttgtggtgccatataaatatgtacatgtgtatatagatttttaggggaaggagagagggaagggtcagggtagagacacccctcccttgcccctttcctgggcccagaagttggggggagggagggaaaggatttttacattttttaaactgctattttctgaatggaacaagctgggccaaggggcccaggccctgtcctctgtccctcacacccctttgctccgttcattcattcaaaaaaacatttcttgagcaccttctgtgcccagcatatgctaggcccaccagctaagtgtgtgtggggggtctctacgccagctcatcagtgcctccttgcccatccttcaccggtgcctttgggggatctgtaggaggtgggaccttctgtggggtttggggatctccaggaagcccgaccaagctgtccccttcccctgtgccaacccatctcctacagccccctgcctgatcccctgctggctgggggcagctcccaggatatcctgccttccaactgtttctgaagcccctcctcctaacatggcgattccggaggtcaaggccttgggctctccccagggtctaacggttaaggggacccacataccagtccccaccccgggcccccgagccgcacttcagatttcccagcgcatcatccaggtcagccagttgttcatcccggagccggtggggctggtgggctagcatgcaactcacacagcgctcctcgtccgccagcagagcgtccagccgctcggcgccggcgcgcagctccagttgcagcggcaccgagtgatgggcgagggcggccgc

SEQ ID NO: 436825 - DNA, 2469 bp, Homo sapiens
cgcctagccgcgccggtcccagaagtggcgaaagccgcagccgagtccaggtcacgccgaagccgttgcccttttaagggggagccttgaaacggcgcctgggttccatgtttgcatccgcctcgcgggaaggaaactccatgttgtaacaaagtttcctccgcgccccctccctccccctcccccctagaacctggctcccctcccctccggagctcgcggggatccctccctcccacccctcccctcccccccgcgccccgattccggccccagccgggggggaggccgggcgcccgggccagagtccggccggagcggagcgcgcccggccccatggacagctcggccgtcattactcagatcagcaaggaggaggctcggggcccgctgcggggcaaaggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctacagaccccagtccaatacctgctccctgaggccaaggcccaggactcagacaagatctgcgtggtcatcgacctggacgagaccctggtgcacagctccttcaagccagtgaacaacgcggacttcatcatccctgtggagattgatggggtggtccaccaggtctacgtgttgaagcgtcctcatgtggatgagttcctgcagcgaatgggcgagctctttgaatgtgtgctgttcactgctagcctcgccaagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggccctgcctgctgctccctttttctgtctctgtccatgctgccatgtttctctgctgccaaattgggccccttggccccttccggttctgcttcctgggggcagggttcctgccttggacccccagtctgggaacggtggacatcaagtgccttgcatagagccccctcttccccgcccagctttcccaggggcacagctctaggctgggaggggagaaccagcccctccccctgccccacctcctcccttgggactgagagggcccctaccaacctttgcctctgccttggagggaggggaggtctgttaccactggggaaggcagcaggagtctgtccttcaggccccacagtgcagcttctccagggccgacagctgagggctgctccctgcatcatccaagcaatgacctcagacttctgccttaaccagccccggggcttggctcccccagctctgagcgtgggggcataggcaggaccccccttgtggtgccatataaatatgtacatgtgtatatagatttttaggggaaggagagagggaagggtcagggtagagacacccctcccttgcccctttcctgggcccagaagttggggggagggagggaaaggatttttacattttttaaactgctattttctgaatggaacaagctgggccaaggggcccaggccctgtcctctgtccctcacacccctttgctccgttcattcattcaaaaaaacatttcttgagcaccttctgtgcccagcatatgctaggcccaccagctaagtgtgtgtggggggtctctacgccagctcatctcccaggatatcctgccttccaactgtttctgaagcccctcctcctaacatggcgattccggaggtcaaggccttgggctctccccagggtctaacggttaaggggacccacataccagtgccaagggggatgtcaagtggtgatgtcgttgtgctcccctcccccagagcgggtgggcggggggtgaatatggttggcctgcatcaggtggccttcccatttaagtgccttctctgtgactgagagccctagtgtgatgagaactaaagagaaagccagaccccta

SEQ ID NO: 436826 - DNA, 1821 bp, Homo sapiens
cgcctagccgcgccggtcccagaagtggcgaaagccgcagccgagtccaggtcacgccgaagccgttgcccttttaagggggagccttgaaacggcgcctgggttccatgtttgcatccgcctcgcgggaaggaaactccatgttgtaacaaagtttcctccgcgccccctccctccccctcccccctagaacctggctcccctcccctccggagctcgcggggatccctccctcccacccctcccctcccccccgcgccccgattccggccccagccgggggggaggccgggcgcccgggccagagtccggccggagcggagcgcgcccggccccatggacagctcggccgtcattactcagatcagcaaggaggaggctcggggcccgctgcggggcaaaggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctacagaccccagtccaatacctgctccctgaggccaaggcccaggactcagacaagatctgcgtggtcatcgacctggacgagaccctggtgcacagctccttcaagccagtgaacaacgcggacttcatcatccctgtggagattgatggggtggtccaccaggtctacgtgttgaagcgtcctcatgtggatgagttcctgcagcgaatgggcgagctctttgaatgtgtgctgttcactgctagcctcgccaagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggccctgcctgctgctccctttttctgtctctgtccatgctgccatgtttctctgctgccaaattgggccccttggccccttccggttctgcttcctgggggcagggttcctgccttggacccccagtctgggaacggtggacatcaagtgccttgcatagagccccctcttccccgcccagctttcccaggggcacagctctaggctgggaggggagaaccagcccctccccctgccccacctcctctccccagggtctaacggttaaggggacccacataccagtgccaagggggatgtcaagtggtgatgtcgttgtgctcccctcccccagagcgggtgggcggggggtgaatatggttggcctgcatcaggtggccttcccatttaagtgccttctctgtgactgagagccctagtgtgatgagaactaaagagaaagccagaccccta

SEQ ID NO: 436827 - DNA, 1525 bp, Homo sapiens
  misc_feature (1423)..(1423): n is a, c, g, or t
  misc_feature (1433)..(1433): n is a, c, g, or t
  misc_feature (1435)..(1435): n is a, c, g, or t
cgcctagccgcgccggtcccagaagtggcgaaagccgcagccgagtccaggtcacgccgaagccgttgcccttttaagggggagccttgaaacggcgcctgggttccatgtttgcatccgcctcgcgggaaggaaactccatgttgtaacaaagtttcctccgcgccccctccctccccctcccccctagaacctggctcccctcccctccggagctcgcggggatccctccctcccacccctcccctcccccccgcgccccgattccggccccagccgggggggaggccgggcgcccgggccagagtccggccggagcggagcgcgcccggccccatggacagctcggccgtcattactcagatcagcaaggaggaggctcggggcccgctgcggggcaaaggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctacagaccccagtccaatacctgctccctgaggccaaggcccaggactcagacaagatctgcgtggtcatcgacctggacgagaccctggtgcacagctccttcaagccagtgaacaacgcggacttcatcatccctgtggagattgatggggtggtccaccaggtctacgtgttgaagcgtcctcatgtggatgagttcctgcagcgaatgggcgagctctttgaatgtgtgctgttcactgctagcctcgccaagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggccctgcctgctgctccctttttctgtctctgtccatgctgccatgtttctcttntgcaatgggncntggccttccggctgtcccgggacggtcccttggacgccgttggacgctggccacgtgcctaaacccttcgccttccgcggactccgcgtg

SEQ ID NO: 436828 - DNA, 1197 bp, Homo sapiens
cttcttgtttgctcgtccttcccctccctcgtcctccgtctgtgtgcggtcgcctgtcgtttcttcttccgtctctctttctgtcttcggcgctttctctcccctctttcgtccctcccgtctattcttcttcctgtcacacacacgctctgcctgtctctctctctctgctcctccgccccccgccttgcgtccccttttctctccttctcgccccccgcgcgcccccgcggtgtgtcgttcttttttttctttctatatatataatacttgttttattttttttttttttttttttttatttatttttttatttttttttttttttgttttttattattttttattatatatttgtattttttattttttattttattttttttttttttttttttgtttgtcgggcttggcattattaatttttaaatggtgaacttacaaaatagtaacgacgagtgaaaagaacttcataaacgaggaaaaagaccaacccgcagacccacggcgcgcaccacggaggggcttgcagcgagaagacagggacctccgttcccaagtgcccagcactgcgccacaggccgggtggaacgggccttgagggcctctggtttgaggtcccccacggtcgggctttgggcccaccgcgtgcggcgccgtgctgggctcctaggatcggcagcgagtccagtgactcccaccgcacccccagtaatcacagggcggccggcgaccgcgggcaggggagggggtctgggaaggcccctggagaaggtggcatttcctcgaggtcggtggaatttggctacgcgaaaggaacagcgcgtacgaaaacttcaggcgggaacgcgcggtggcccgtgcgcggcgggtagacgtgcggggccccgggtggggccgtggggagaggtcggcagggggctttcccagggcagagagttagaatttcacgtcctacagaccgggggcacctcgccctggggctgcggggggcggcgaccgtcccattcaagagcgtgattctgaggtttgcacagctgtttcgggccagcagagccttcgctggctcttgacgtccttgcgaggtgatctctgcgaccaccagacaggagagaagacccattttacagatgaggtagtgctatctccaagtcctcaacgaggaaaccgagaagcctctagtcccgggtcttcaga

SEQ ID NO: 436829 - DNA, 582 bp, Homo sapiens
cttcttgtttgctcgtccttcccctccctcgtcctccgtctgtgtgcggtcgcctgtcgtttcttcttccgtctctctttctgtcttcggcgctttctctcccctctttcgtccctcccgtctattcttcttcctgtcacacacacgctctgcctgtctctctctctctgctcctccgccccccgccttgcgtccccttttctctccttctcgccccccgcgcgcccccgcggtgtgtcgttcttttttttctttctatatatataatacttgttttattttttttttttttttttttttatttatttttttatttttttttttttttgttttttattattttttattatatatttgtattttttattttttattttattttttttttttttttttttgtttgtcgggcttggcattattaatttttaaatggtgaacttacaaaatagtaacgacgagtgaaaagaacttcataaacgaggaaaaagaccaacccgcagacccacggcgcaaaattctctatttaataaatattatgctctaagcctgggctcagagctttcatctcatttaattctcacc

SEQ ID NO: 436830 - DNA, 2876 bp, Homo sapiens
cggccgccttagctgtgcccgaagctcccagcccgagagggagcagggagagagtttgaactcagaggaggctcagagacgcggggcggggcctggcgcctttggggcgctcctgtccgctcgaggtgaggaaactgaggcaggaatagagagggaactccttcgggggtttcctggcaggcattgcgtggtgcatgggcgcccccccaccattggcgccaatggggctgggagatgggggagctgaggagggcgcctatgggccacccgtgagactccgccccaccccccacccccacccccccgggctgcggtccggtagggtcttgggagggggcgccgaggtgacagcaggctggggaggcttggagggatctcccgccaacacacagctacgttccccacaaacttcgcgtcacgcgtggaggcgccgaccccctcggaggcacagagaggacggccggcacttccaagagtcgcttggcgcccgcggggagagtcgtgcgcctagtgggcacgcaccaccccgcaaagcctcgccgccccgacgaggctgcgtcccccagcgtggctgggccggggtgggggggtctgtcttctccttttccccgtgtggacctcaggatctggacgctgcccccaggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctacagaccccagtccaatacctgctccctgaggccaaggcccaggactcagacaagatctgcgtggtcatcgacctggacgagaccctggtgcacagctccttcaagccagtgaacaacgcggacttcatcatccctgtggagattgatggggtggtccaccaggtctacgtgttgaagcgtcctcatgtggatgagttcctgcagcgaatgggcgagctctttgaatgtgtgctgttcactgctagcctcgccaagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggccctgcctgctgctccctttttctgtctctgtccatgctgccatgtttctctgctgccaaattgggccccttggccccttccggttctgcttcctgggggcagggttcctgccttggacccccagtctgggaacggtggacatcaagtgccttgcatagagccccctcttccccgcccagctttcccaggggcacagctctaggctgggaggggagaaccagcccctccccctgccccacctcctcccttgggactgagagggcccctaccaacctttgcctctgccttggagggaggggaggtctgttaccactggggaaggcagcaggagtctgtccttcaggccccacagtgcagcttctccagggccgacagctgagggctgctccctgcatcatccaagcaatgacctcagacttctgccttaaccagccccggggcttggctcccccagctctgagcgtgggggcataggcaggaccccccttgtggtgccatataaatatgtacatgtgtatatagatttttaggggaaggagagagggaagggtcagggtagagacacccctcccttgcccctttcctgggcccagaagttggggggagggagggaaaggatttttacattttttaaactgctattttctgaatggaacaagctgggccaaggggcccaggccctgtcctctgtccctcacacccctttgctccgttcattcattcaaaaaaacatttcttgagcaccttctgtgcccagcatatgctaggcccaccagctaagtgtgtgtggggggtctctacgccagctcatcagtgcctccttgcccatccttcaccggtgcctttgggggatctgtaggaggtgggaccttctgtggggtttggggatctccaggaagcccgaccaagctgtccccttcccctgtgccaacccatctcctacagccccctgcctgatcccctgctggctgggggcagctcccaggatatcctgccttccaactgtttctgaagcccctcctcctaacatggcgattccggaggtcaaggccttgggctctccccagggtctaacggttaaggggacccacataccagtgccaagggggatgtcaagtggtgatgtcgttgtgctcccctcccccagagcgggtgggcggggggtgaatatggttggcctgcatcaggtggccttcccatttaagtgccttctctgtgactgagagccctagtgtgatgagaactaaagagaaagccagaccccta

SEQ ID NO: 436831 - DNA, 2220 bp, Homo sapiens
attaggcgcgtctgcgtctccacagcataagcccctgccagcagggccagggtagcccctgtgatgtgcactcgccctggtacaccgcctgcctccatgtggttagccagtgtgacatcatgtgaccaaacgtcgtactgccacttctgcagcccgatgactccacgcagaacgcgcctaatggcgcgatctgcgtggtcatcgacctggacgagaccctggtgcacagctccttcaagccagtgaacaacgcggacttcatcatccctgtggagattgatggggtggtccaccaggtctacgtgttgaagcgtcctcatgtggatgagttcctgcagcgaatgggcgagctctttgaatgtgtgctgttcactgctagcctcgccaagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggccctgcctgctgctccctttttctgtctctgtccatgctgccatgtttctctgctgccaaattgggccccttggccccttccggttctgcttcctgggggcagggttcctgccttggacccccagtctgggaacggtggacatcaagtgccttgcatagagccccctcttccccgcccagctttcccaggggcacagctctaggctgggaggggagaaccagcccctccccctgccccacctcctcccttgggactgagagggcccctaccaacctttgcctctgccttggagggaggggaggtctgttaccactggggaaggcagcaggagtctgtccttcaggccccacagtgcagcttctccagggccgacagctgagggctgctccctgcatcatccaagcaatgacctcagacttctgccttaaccagccccggggcttggctcccccagctctgagcgtgggggcataggcaggaccccccttgtggtgccatataaatatgtacatgtgtatatagatttttaggggaaggagagagggaagggtcagggtagagacacccctcccttgcccctttcctgggcccagaagttggggggagggagggaaaggatttttacattttttaaactgctattttctgaatggaacaagctgggccaaggggcccaggccctgtcctctgtccctcacacccctttgctccgttcattcattcaaaaaaacatttcttgagcaccttctgtgcccagcatatgctaggcccaccagctaagtgtgtgtggggggtctctacgccagctcatcagtgcctccttgcccatccttcaccggtgcctttgggggatctgtaggaggtgggaccttctgtggggtttggggatctccaggaagcccgaccaagctgtccccttcccctgtgccaacccatctcctacagccccctgcctgatcccctgctggctgggggcagctcccaggatatcctgccttccaactgtttctgaagcccctcctcctaacatggcgattccggaggtcaaggccttgggctctccccagggtctaacggttaaggggacccacataccagtgccaagggggatgtcaagtggtgatgtcgttgtgctcccctcccccagagcgggtgggcggggggtgaatatggttggcctgcatcaggtggccttcccatttaagtgccttctctgtgactgagagccctagtgtgatgagaactaaagagaaagccagaccccta

SEQ ID NO: 436832 - DNA, 2600 bp, Homo sapiens
cgcctagccgcgccggtcccagaagtggcgaaagccgcagccgagtccaggtcacgccgaagccgttgcccttttaagggggagccttgaaacggcgcctgggttccatgtttgcatccgcctcgcgggaaggaaactccatgttgtaacaaagtttcctccgcgccccctccctccccctcccccctagaacctggctcccctcccctccggagctcgcggggatccctccctcccacccctcccctcccccccgcgccccgattccggccccagccgggggggaggccgggcgcccgggccagagtccggccggagcggagcgcgcccggccccatggacagctcggccgtcattactcagatcagcaaggaggaggctcggggcccgctgcggggcaaaggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctacagaccccagtccaatacctgctccctgaggccaaggcccaggactcagacaagatctgcgtggtcatcgacctggacgagaccctggtgcacagctccttcaagccagtgaacaacgcggacttcatcatccctgtggagattgatggggtggtccaccaggtctacgtgttgaagcgtcctcatgtggatgagttcctgcagcgaatgggcgagctctttgaatgtgtgctgttcactgctagcctcgccaagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggccctgcctgctgctccctttttctgtctctgtccatgctgccatgtttctctgcttcctgggggcagggttcctgccttggacccccagtctgggaacggtggacatcaagtgccttgcatagagccccctcttccccgcccagctttcccaggggcacagctctaggctgggaggggagaaccagcccctccccctgccccacctcctcccttgggactgagagggcccctaccaacctttgcctctgccttggagggaggggaggtctgttaccactggggaaggcagcaggagtctgtccttcaggccccacagtgcagcttctccagggccgacagctgagggctgctccctgcatcatccaagcaatgacctcagacttctgccttaaccagccccggggcttggctcccccagctctgagcgtgggggcataggcaggaccccccttgtggtgccatataaatatgtacatgtgtatatagatttttaggggaaggagagagggaagggtcagggtagagacacccctcccttgcccctttcctgggcccagaagttggggggagggagggaaaggatttttacattttttaaactgctattttctgaatggaacaagctgggccaaggggcccaggccctgtcctctgtccctcacacccctttgctccgttcattcattcaaaaaaacatttcttgagcaccttctgtgcccagcatatgctaggcccaccagctaagtgtgtgtggggggtctctacgccagctcatcagtgcctccttgcccatccttcaccggtgcctttgggggatctgtaggaggtgggaccttctgtggggtttggggatctccaggaagcccgaccaagctgtccccttcccctgtgccaacccatctcctacagccccctgcctgatcccctgctggctgggggcagctcccaggatatcctgccttccaactgtttctgaagcccctcctcctaacatggcgattccggaggtcaaggccttgggctctccccagggtctaacggttaaggggacccacataccagtgccaagggggatgtcaagtggtgatgtcgttgtgctcccctcccccagagcgggtgggcggggggtgaatatggttggcctgcatcaggtggccttcccatttaagtgccttctctgtgactgagagccctagtgtgatgagaactaaagagaaagccagaccccta

SEQ ID NO: 436833 - DNA, 1907 bp, Homo sapiens
gggcaacagagcaagaccctgcctcaaaaaaaaaaaaaagtatccgagtgcttcgcacagataaggttaggaattgtgaagcttttgcattgttacgttataaatgtgttttcctggggattgctgtcaaaaaagtttgaacactgtgggtgaggggttttcagaaactgcatgatctgagtagtggctacatagggctggcctggaaattctgcacccaggaccacctgcccccctcatcttcctacacccacttccccaggtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggccctgcctgctgctccctttttctgtctctgtccatgctgccatgtttctctgctgccaaattgggccccttggccccttccggttctgcttcctgggggcagggttcctgccttggacccccagtctgggaacggtggacatcaagtgccttgcatagagccccctcttccccgcccagctttcccaggggcacagctctaggctgggaggggagaaccagcccctccccctgccccacctcctcccttgggactgagagggcccctaccaacctttgcctctgccttggagggaggggaggtctgttaccactggggaaggcagcaggagtctgtccttcaggccccacagtgcagcttctccagggccgacagctgagggctgctccctgcatcatccaagcaatgacctcagacttctgccttaaccagccccggggcttggctcccccagctctgagcgtgggggcataggcaggaccccccttgtggtgccatataaatatgtacatgtgtatatagatttttaggggaaggagagagggaagggtcagggtagagacacccctcccttgcccctttcctgggcccagaagttggggggagggagggaaaggatttttacattttttaaactgctattttctgaatggaacaagctgggccaaggggcccaggccctgtcctctgtccctcacacccctttgctccgttcattcattcaaaaaaacatttcttgagcaccttctgtgcccagcatatgctaggcccaccagctaagtgtgtgtggggggtctctacgccagctcatcagtgcctccttgcccatccttcaccggtgcctttgggggatctgtaggaggtgggaccttctgtggggtttggggatctccaggaagcccgaccaagctgtccccttcccctgtgccaacccatctcctacagccccctgcctgatcccctgctggctgggggcagctcccaggatatcctgccttccaactgtttctgaagcccctcctcctaacatggcgattccggaggtcaaggccttgggctctccccagggtctaacggttaaggggacccacataccagtgccaagggggatgtcaagtggtgatgtcgttgtgctcccctcccccagagcgggtgggcggggggtgaatatggttggcctgcatcaggtggccttcccatttaagtgccttctctgtgactgagagccctagtgtgatgagaactaaagagaaagccagaccccta

SEQ ID NO: 436834 - DNA, 2016 bp, Homo sapiens
cgcctagccgcgccggtcccagaagtggcgaaagccgcagccgagtccaggtcacgccgaagccgttgcccttttaagggggagccttgaaacggcgcctgggttccatgtttgcatccgcctcgcgggaaggaaactccatgttgtaacaaagtttcctccgcgccccctccctccccctcccccctagaacctggctcccctcccctccggagctcgcggggatccctccctcccacccctcccctcccccccgcgccccgattccggccccagccgggggggaggccgggcgcccgggccagagtccggccggagcggagcgcgcccggccccatggacagctcggccgtcattactcagatcagcaaggaggaggctcggggcccgctgcggggcaaaggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctacagaccccagtccaatacctgctccctgaggccaaggcccaggactcagacaagatctgcgtggtcatcgacctggacgagaccctggtgcacagctccttcaagccagtgaacaacgcggacttcatcatccctgtggagattgatggggtggtccaccaggtctacgtgttgaagcgtcctcatgtggatgagttcctgcagcgaatgggcgagctctttgaatgtgtgctgttcactgctagcctcgccaagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggccctgcctgctgctccctttttctgtctctgtccatgctgccatgtttctgggcccaggccctgtcctctgtccctcacacccctttgctccgttcattcattcaaaaaaacatttcttgagcaccttctgtgcccagcatatgctaggcccaccagctaagtgtgtgtggggggtctctacgccagctcatcagtgcctccttgcccatccttcaccggtgcctttgggggatctgtaggaggtgggaccttctgtggggtttggggatctccaggaagcccgaccaagctgtccccttcccctgtgccaacccatctcctacagccccctgcctgatcccctgctggctgggggcagctcccaggatatcctgccttccaactgtttctgaagcccctcctcctaacatggcgattccggaggtcaaggccttgggctctccccagggtctaacggttaaggggacccacataccagtgccaagggggatgtcaagtggtgatgtcgttgtgctcccctcccccagagcgggtgggcggggggtgaatatggttggcctgcatcaggtggccttcccatttaagtgccttctctgtgactgagagccctagtgtgatgagaactaaagagaaagccagaccccta

SEQ ID NO: 436835 - DNA, 2557 bp, Homo sapiens
cgcctagccgcgccggtcccagaagtggcgaaagccgcagccgagtccaggtcacgccgaagccgttgcccttttaagggggagccttgaaacggcgcctgggttccatgtttgcatccgcctcgcgggaaggaaactccatgttgtaacaaagtttcctccgcgccccctccctccccctcccccctagaacctggctcccctcccctccggagctcgcggggatccctccctcccacccctcccctcccccccgcgccccgattccggccccagccgggggggaggccgggcgcccgggccagagtccggccggagcggagcgcgcccggccccatggacagctcggccgtcattactcagatcagcaaggaggaggctcggggcccgctgcggggcaaaggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctacagaccccagtccaatacctgctccctgaggccaaggcccaggactcagacaagatctgcgtggtcatcgacctggacgagaccctggtgcacagctccttcaagccagtgaacaacgcggacttcatcatccctgtggagattgatggggtggtccaccaggtctacgtgttgaagcgtcctcatgtggatgagttcctgcagcgaatgggcgagctctttgaatgtgtgctgttcactgctagcctcgccaagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggccctgcctgctgctccctttttctgtctctgtccatgctgccatgtttctctgctgccaaattgggccccttggccccttccggttctgcttcctgggggcagggttcctgccttggacccccagtctgggaacggtggacatcaagtgccttgcatagagccccctcttccccgcccagctttcccaggggcacagctctaggctgggaggggagaaccagcccctccccctgccccacctcctcccttgggactgagagggcccctaccaacctttgcctctgccttggagggaggggaggtctgttaccactggggaaggcagcaggagtctgtccttcaggccccacagtgcagcttctccagggccgacagctgagggctgctccctgcatcatccaagcaatgacctcagacttctgccttaaccagccccggggcttggctcccccagctctgagcgtgggggcataggcaggaccccccttgtggtgccatataaatatgtacatgtgtatatagatttttaggggaaggagagagggaagggtcagggtagagacacccctcccttgcccctttcctgggcccagaagttggggggagggagggaaaggatttttacattttttaaactgctattttctgaatggaacaagctgggccaaggggcccaggccctgtcctctgtccctcacacccctttgctccgttcattcattcaaaaaaacatttcttgagcaccttctgtgcccagcatatgctaggcccaccagctaagtgtgtgtggggggtctctacgccagctcatcagtgcctccttgcccatccttcaccggtgcctttgggggatctgtaggaggtgggaccttctgtggggtttggggatctccaggaagctcccaggatatcctgccttccaactgtttctgaagcccctcctcctaacatggcgattccggaggtcaaggccttgggctctccccagggtctaacggttaaggggacccacataccagtgccaagggggatgtcaagtggtgatgtcgttgtgctcccctcccccagagcgggtgggcggggggtgaatatggttggcctgcatcaggtggccttcccatttaagtgccttctctgtgactgagagccctagtgtgatgagaactaaagagaaagccagaccccta

SEQ ID NO: 436836 - DNA, 2169 bp, Homo sapiens
cgcctagccgcgccggtcccagaagtggcgaaagccgcagccgagtccaggtcacgccgaagccgttgcccttttaagggggagccttgaaacggcgcctgggttccatgtttgcatccgcctcgcgggaaggaaactccatgttgtaacaaagtttcctccgcgccccctccctccccctcccccctagaacctggctcccctcccctccggagctcgcggggatccctccctcccacccctcccctcccccccgcgccccgattccggccccagccgggggggaggccgggcgcccgggccagagtccggccggagcggagcgcgcccggccccatggacagctcggccgtcattactcagatcagcaaggaggaggctcggggcccgctgcggggcaaaggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctacagaccccagtccaatacctgctccctgaggccaaggcccaggactcagacaagatctgcgtggtcatcgacctggacgagaccctggtgcacagctccttcaagccagtgaacaacgcggacttcatcatccctgtggagattgatggggtggtccaccaggtctacgtgttgaagcgtcctcatgtggatgagttcctgcagcgaatgggcgagctctttgaatgtgtgctgttcactgctagcctcgccaagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggccctgcctgctgctccctttttctgtctctgtccatgctgccatgtttctctgctgccaaattgggccccttggccccttccggttctgcttcctgggggcagggttcctgccttggacccccagtctgggaacggtggacatcaagtgccttgcatagagccccctcttccccgcccagctttcccaggggcacagctctaggctgggaggggagaaccagcccctccccctgccccacctcctcccttgggactgagagggcccctaccaacctttgcctctgccttggagggaggggaggtctgttaccactggggaaggcagcaggagtctgtccttcaggccccacagtgcagcttctccagggccgacagctgagggctgctccctgcatcatccaagcaatgacctcagacttctgccagtgcctccttgcccatccttcaccggtgcctttgggggatctgtaggaggtgggaccttctgtggggtttggggatctccaggaagctcccaggatatcctgccttccaactgtttctgaagcccctcctcctaacatggcgattccggaggtcaaggccttgggctctccccagggtctaacggttaaggggacccacataccagtgccaagggggatgtcaagtggtgatgtcgttgtgctcccctcccccagagcgggtgggcggggggtgaatatggttggcctgcatcaggtggccttcccatttaagtgccttctctgtgactgagagccctagtgtgatgagaactaaagagaaagccagaccccta

SEQ ID NO: 436837 - DNA, 1929 bp, Homo sapiens
cttcttgtttgctcgtccttcccctccctcgtcctccgtctgtgtgcggtcgcctgtcgtttcttcttccgtctctctttctgtcttcggcgctttctctcccctctttcgtccctcccgtctattcttcttcctgtcacacacacgctctgcctgtctctctctctctgctcctccgccccccgccttgcgtccccttttctctccttctcgccccccgcgcgcccccgcggtgtgtcgttcttttttttctttctatatatataatacttgttttattttttttttttttttttttttatttatttttttatttttttttttttttgttttttattattttttattatatatttgtattttttattttttattttattttttttttttttttttttgtttgtcgggcttggcattattaatttttaaatggtgaacttacaaaatagtaacgacgagtgaaaagaacttcataaacgaggaaaaagaccaacccgcagacccacggcgcgcaccacggaggggcttgcagcgagaagacagggacctccgttcccaagtgcccagcactgcgccacaggccgggtggaacgggccttgagggcctctggtttgaggtcccccacggtcgggctttgggcccaccgcgtgcggcgccgtgctgggctcctaggatcggcagcgagtccagtgactcccaccgcacccccagtaatcacagggcggccggcgaccgcgggcaggggagggggtctgggaaggcccctggagaaggtggcatttcctcgaggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctacagaccccagtccaatacctgctccctgaggccaaggcccaggactcagacaagatctgcgtggtcatcgacctggacgagaccctggtgcacagctccttcaagccagtgaacaacgcggacttcatcatccctgtggagattgatggggtggtccaccaggtctacgtgttgaagcgtcctcatgtggatgagttcctgcagcgaatgggcgagctctttgaatgtgtgctgttcactgctagcctcgccaagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtgagtgcgggctggactgggactgggacaggagctgagacccaggaaggggtcagtccattcaggccaccttggcctcttggatccccagttggggggtgggtgccctcccagtccttcctgcattcattgcctgtgcctgccgcccactcccctcatccacctgccctgtagccatatggtcttttcccctcgcacaaagcagagcatctgccatgcacaggggcccccacagggcaacggagtttggaaagtttcaatttttcgaattgccagttgtgacctactgatggcccacagaattaatttagtgggttctgattgggaattttaacaaaatgaaatagaatagaaaatatccggtcgggtgcagtggctcatgcctgtaatcccagcactttgggaagctgaggtgggcaggtagctgagcccagtagttcaagaccagcctcggcaacatagtgaaaccttatgtctacaaaaaatacaaaaactagccaggcgtggtggcgcatgcctggagtcccggctatgcagaaggctgaggtagg

SEQ ID NO: 436838 - DNA, 649 bp, Homo sapiens
cagatccacttcaaggaaacactgacttgaaaactctcccccatggttttgtctgaactggctgccattctgcagcacacaccagatccaattgctggagtcgggaacccgagagatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatgggatgcggcctaattttttgttttttgtaataaatgaataacataaccgaccgg

SEQ ID NO: 436839 - DNA, 1340 bp, Homo sapiens
gtaatctgcaacgactctcttaatcctccacggctacacgtgaaacagtcgcaaatggaatttcaagaaacattctatatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatgaatggaaaagtatattctgtgttttaagtctctttaataaaaaacaaaacaaaatccaaaaaaactcctaacatggcaactcaggacattttaatccttttttttgttgttgggcttctgataggatccattttattgattccataaatatttagtagactttagacatattaatacattgtagtttgagttaatttgcattaaattctgtttttttccccttaggtatagattgtctgttggaaaaatatattgcttgtggatttcttggggagtgggaaggtgaattatacctgttgtctctacagtccactaccttccacaccctagggcagtggtccccaaccttcttggcaccagggatcagtttcctggaagacaatttttctgtggatggtgtggggatggttttgggatggaactgtccacctcagatcatcaggcattagttaggctctcataacgagtgcgcagcctagatccctcacatgcacagttcacagtagggtttgcgctgctatgagaatctaaggctgccactgatctgacaggaggcagaactcaggtggcaatgcttactggcccactgctcacctcttgctgtgcggcctggttcctaataggccatggacccccacagacgggtactagtctgcagcctgtggaccccagccctaggggcctgccattctgagtgagttattagcatgaagaagaggaagatctggatcaaacgtgggtgatggtactcagagacccaagataggatagggatggaacaa

SEQ ID NO: 436840 - DNA, 1377 bp, Homo sapiens
gtttttatattaaccacggattcagctaaggagaggccccggatcaggacagcagtttcctcagacgtgatgtggtgccccttgcatcctgctcagagaattctcagcagcacagatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatgaatggaaaagtatattctgtgttttaagtctctttaataaaaaacaaaacaaaatccaaaaaaactcctaacatggcaactcaggacattttaatccttttttttgttgttgggcttctgataggatccattttattgattccataaatatttagtagactttagacatattaatacattgtagtttgagttaatttgcattaaattctgtttttttccccttaggtatagattgtctgttggaaaaatatattgcttgtggatttcttggggagtgggaaggtgaattatacctgttgtctctacagtccactaccttccacaccctagggcagtggtccccaaccttcttggcaccagggatcagtttcctggaagacaatttttctgtggatggtgtggggatggttttgggatggaactgtccacctcagatcatcaggcattagttaggctctcataacgagtgcgcagcctagatccctcacatgcacagttcacagtagggtttgcgctgctatgagaatctaaggctgccactgatctgacaggaggcagaactcaggtggcaatgcttactggcccactgctcacctcttgctgtgcggcctggttcctaataggccatggacccccacagacgggtactagtctgcagcctgtggaccccagccctaggggcctgccattctgagtgagttattagcatgaagaagaggaagatctggatcaaacgtgggtgatggtactcagagacccaagataggatagggatggaacaa

SEQ ID NO: 436841 - DNA, 1750 bp, Homo sapiens
agcggaacgccgccgctgccgccgccgggggtgggagccgcgctcgcccgcccgcccctcgactcgcgagggcgtaaaagtttgtctcagctcgagcattcctagcgccaacacgccctcaggtaaaggtggaagtaaatggccacgctgtattgacagagcaggtagatgaaactcaagagaaaaggtgtggataaatgaaactagcccatgatgaacctgttttctccgtgaccaacaattattaaccaggatgaatggcggtggcagtgggcctgcatcacaggttgcagcagatgttctcaatatttctattaaaatttccttatttccatatgcaagaggagccacagagctgcatccttatggtagctaccatgccgtgatgtaagctgccattcactggggagctttggcaatagaattggctagatcaggaagcctatgtcaactatggaacaacaacttgcagctcatctctattgatgatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatgaatggaaaagtatattctgtgttttaagtctctttaataaaaaacaaaacaaaatccaaaaaaactcctaacatggcaactcaggacattttaatccttttttttgttgttgggcttctgataggatccattttattgattccataaatatttagtagactttagacatattaatacattgtagtttgagttaatttgcattaaattctgtttttttccccttaggtatagattgtctgttggaaaaatatattgcttgtggatttcttggggagtgggaaggtgaattatacctgttgtctctacagtccactaccttccacaccctagggcagtggtccccaaccttcttggcaccagggatcagtttcctggaagacaatttttctgtggatggtgtggggatggttttgggatggaactgtccacctcagatcatcaggcattagttaggctctcataacgagtgcgcagcctagatccctcacatgcacagttcacagtagggtttgcgctgctatgagaatctaaggctgccactgatctgacaggaggcagaactcaggtggcaatgcttactggcccactgctcacctcttgctgtgcggcctggttcctaataggccatggacccccacagacgggtactagtctgcagcctgtggaccccagccctaggggcctgccattctgagtgagttattagcatgaagaagaggaagatctggatcaaacgtgggtgatggtactcagagacccaagataggatagggatggaacaa

SEQ ID NO: 436842 - DNA, 1430 bp, Homo sapiens
gtaatctgcaacgactctcttaatcctccacggctacacgtgaaacagtcgcaaatggaatttcaagaaacattctatctaaggagaggccccggatcaggacagcagtttcctcagacgtgatgtggtgccccttgcatcctgctcagagaattctcagcagcacagatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatgaatggaaaagtatattctgtgttttaagtctctttaataaaaaacaaaacaaaatccaaaaaaactcctaacatggcaactcaggacattttaatccttttttttgttgttgggcttctgataggatccattttattgattccataaatatttagtagactttagacatattaatacattgtagtttgagttaatttgcattaaattctgtttttttccccttaggtatagattgtctgttggaaaaatatattgcttgtggatttcttggggagtgggaaggtgaattatacctgttgtctctacagtccactaccttccacaccctagggcagtggtccccaaccttcttggcaccagggatcagtttcctggaagacaatttttctgtggatggtgtggggatggttttgggatggaactgtccacctcagatcatcaggcattagttaggctctcataacgagtgcgcagcctagatccctcacatgcacagttcacagtagggtttgcgctgctatgagaatctaaggctgccactgatctgacaggaggcagaactcaggtggcaatgcttactggcccactgctcacctcttgctgtgcggcctggttcctaataggccatggacccccacagacgggtactagtctgcagcctgtggaccccagccctaggggcctgccattctgagtgagttattagcatgaagaagaggaagatctggatcaaacgtgggtgatggtactcagagacccaagataggatagggatggaacaa

SEQ ID NO: 436843 - DNA, 1366 bp, Homo sapiens
  misc_feature (11)..(11): n is a, c, g, or t
  misc_feature (20)..(20): n is a, c, g, or t
  misc_feature (39)..(39): n is a, c, g, or t
gttttaacccngcttggatnaaagccagctcgggacagnacacctttcctcagacgtgatgtggtgccccttgcatcctgctcagagaattctcagcagcacagatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatgaatggaaaagtatattctgtgttttaagtctctttaataaaaaacaaaacaaaatccaaaaaaactcctaacatggcaactcaggacattttaatccttttttttgttgttgggcttctgataggatccattttattgattccataaatatttagtagactttagacatattaatacattgtagtttgagttaatttgcattaaattctgtttttttccccttaggtatagattgtctgttggaaaaatatattgcttgtggatttcttggggagtgggaaggtgaattatacctgttgtctctacagtccactaccttccacaccctagggcagtggtccccaaccttcttggcaccagggatcagtttcctggaagacaatttttctgtggatggtgtggggatggttttgggatggaactgtccacctcagatcatcaggcattagttaggctctcataacgagtgcgcagcctagatccctcacatgcacagttcacagtagggtttgcgctgctatgagaatctaaggctgccactgatctgacaggaggcagaactcaggtggcaatgcttactggcccactgctcacctcttgctgtgcggcctggttcctaataggccatggacccccacagacgggtactagtctgcagcctgtggaccccagccctaggggcctgccattctgagtgagttattagcatgaagaagaggaagatctggatcaaacgtgggtgatggtactcagagacccaagataggatagggatggaacaa

SEQ ID NO: 436844 - DNA, 1836 bp, Homo sapiens
tccatgctgccctcatgggggctttcctacctagctgatgtttgaagttttcatgtgtgcctctgtctttgacccacctggctagttcagagcctttgctgaagaaaatgttctttgcttgtccgattgcttcacagcacgcttctctatctgcaactgttgtttcccagccatccatatggtgccacaggatgggacacaggcagggactttactattcacaaaggggtagggcctgggacctcgagtggggcttttcctgcttataaagacaaggaatgaaaatgcagaatccttacctggtaggggaactttcttttccaaatatgcaggtatgtatatttctgatttccttaggcttggatctgtgcctgggggtgagatggatttcaaagtcattatttaaagtagggagataaagctttagacaaccaccataagagatcctggttgtatttttgaaatgttgagcgaaataacattttagtgatcagtaaaagctaacctttgtacttctgaaaagttgttcttagaaaggcctggattaataattggtttcaatttgcccacagatatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatgaatggaaaagtatattctgtgttttaagtctctttaataaaaaacaaaacaaaatccaaaaaaactcctaacatggcaactcaggacattttaatccttttttttgttgttgggcttctgataggatccattttattgattccataaatatttagtagactttagacatattaatacattgtagtttgagttaatttgcattaaattctgtttttttccccttaggtatagattgtctgttggaaaaatatattgcttgtggatttcttggggagtgggaaggtgaattatacctgttgtctctacagtccactaccttccacaccctagggcagtggtccccaaccttcttggcaccagggatcagtttcctggaagacaatttttctgtggatggtgtggggatggttttgggatggaactgtccacctcagatcatcaggcattagttaggctctcataacgagtgcgcagcctagatccctcacatgcacagttcacagtagggtttgcgctgctatgagaatctaaggctgccactgatctgacaggaggcagaactcaggtggcaatgcttactggcccactgctcacctcttgctgtgcggcctggttcctaataggccatggacccccacagacgggtactagtctgcagcctgtggaccccagccctaggggcctgccattctgagtgagttattagcatgaagaagaggaagatctggatcaaacgtgggtgatggtactcagagacccaagataggatagggatggaacaa

SEQ ID NO: 436845 - DNA, 1309 bp, Homo sapiens
  misc_feature (25)..(25): n is a, c, g, or t
aaaaggaaatgttgtgttgatagtncggaaaagaaaataataactctatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatgaatggaaaagtatattctgtgttttaagtctctttaataaaaaacaaaacaaaatccaaaaaaactcctaacatggcaactcaggacattttaatccttttttttgttgttgggcttctgataggatccattttattgattccataaatatttagtagactttagacatattaatacattgtagtttgagttaatttgcattaaattctgtttttttccccttaggtatagattgtctgttggaaaaatatattgcttgtggatttcttggggagtgggaaggtgaattatacctgttgtctctacagtccactaccttccacaccctagggcagtggtccccaaccttcttggcaccagggatcagtttcctggaagacaatttttctgtggatggtgtggggatggttttgggatggaactgtccacctcagatcatcaggcattagttaggctctcataacgagtgcgcagcctagatccctcacatgcacagttcacagtagggtttgcgctgctatgagaatctaaggctgccactgatctgacaggaggcagaactcaggtggcaatgcttactggcccactgctcacctcttgctgtgcggcctggttcctaataggccatggacccccacagacgggtactagtctgcagcctgtggaccccagccctaggggcctgccattctgagtgagttattagcatgaagaagaggaagatctggatcaaacgtgggtgatggtactcagagacccaagataggatagggatggaacaa

SEQ ID NO: 436846 - DNA, 1436 bp, Homo sapiens
gtaatctgcaacgactctcttaatcctccacggctacacgtgaaacagtcgcaaatggaatttcaagaaacattctatcatcaggtattatctactgctgtctgcagaattcagacatggagggctcaatggtgtcccctggtctttggaacattctgtattttaatgatcatgatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatgaatggaaaagtatattctgtgttttaagtctctttaataaaaaacaaaacaaaatccaaaaaaactcctaacatggcaactcaggacattttaatccttttttttgttgttgggcttctgataggatccattttattgattccataaatatttagtagactttagacatattaatacattgtagtttgagttaatttgcattaaattctgtttttttccccttaggtatagattgtctgttggaaaaatatattgcttgtggatttcttggggagtgggaaggtgaattatacctgttgtctctacagtccactaccttccacaccctagggcagtggtccccaaccttcttggcaccagggatcagtttcctggaagacaatttttctgtggatggtgtggggatggttttgggatggaactgtccacctcagatcatcaggcattagttaggctctcataacgagtgcgcagcctagatccctcacatgcacagttcacagtagggtttgcgctgctatgagaatctaaggctgccactgatctgacaggaggcagaactcaggtggcaatgcttactggcccactgctcacctcttgctgtgcggcctggttcctaataggccatggacccccacagacgggtactagtctgcagcctgtggaccccagccctaggggcctgccattctgagtgagttattagcatgaagaagaggaagatctggatcaaacgtgggtgatggtactcagagacccaagataggatagggatggaacaa

SEQ ID NO: 436847 - DNA, 1315 bp, Homo sapiens
ttgtaggacctctaacaatgatattggaagaatagatactaagtcttggagagatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatgaatggaaaagtatattctgtgttttaagtctctttaataaaaaacaaaacaaaatccaaaaaaactcctaacatggcaactcaggacattttaatccttttttttgttgttgggcttctgataggatccattttattgattccataaatatttagtagactttagacatattaatacattgtagtttgagttaatttgcattaaattctgtttttttccccttaggtatagattgtctgttggaaaaatatattgcttgtggatttcttggggagtgggaaggtgaattatacctgttgtctctacagtccactaccttccacaccctagggcagtggtccccaaccttcttggcaccagggatcagtttcctggaagacaatttttctgtggatggtgtggggatggttttgggatggaactgtccacctcagatcatcaggcattagttaggctctcataacgagtgcgcagcctagatccctcacatgcacagttcacagtagggtttgcgctgctatgagaatctaaggctgccactgatctgacaggaggcagaactcaggtggcaatgcttactggcccactgctcacctcttgctgtgcggcctggttcctaataggccatggacccccacagacgggtactagtctgcagcctgtggaccccagccctaggggcctgccattctgagtgagttattagcatgaagaagaggaagatctggatcaaacgtgggtgatggtactcagagacccaagataggatagggatggaacaa

SEQ ID NO: 436848 - DNA, 1325 bp, Homo sapiens
  misc_feature (22)..(22): n is a, c, g, or t
  misc_feature (26)..(26): n is a, c, g, or t
  misc_feature (31)..(33): n is a, c, g, or t
aaatactccaaaataataatanaaanaaaannnttttgaatagaaattaggcaattgtccactatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatgaatggaaaagtatattctgtgttttaagtctctttaataaaaaacaaaacaaaatccaaaaaaactcctaacatggcaactcaggacattttaatccttttttttgttgttgggcttctgataggatccattttattgattccataaatatttagtagactttagacatattaatacattgtagtttgagttaatttgcattaaattctgtttttttccccttaggtatagattgtctgttggaaaaatatattgcttgtggatttcttggggagtgggaaggtgaattatacctgttgtctctacagtccactaccttccacaccctagggcagtggtccccaaccttcttggcaccagggatcagtttcctggaagacaatttttctgtggatggtgtggggatggttttgggatggaactgtccacctcagatcatcaggcattagttaggctctcataacgagtgcgcagcctagatccctcacatgcacagttcacagtagggtttgcgctgctatgagaatctaaggctgccactgatctgacaggaggcagaactcaggtggcaatgcttactggcccactgctcacctcttgctgtgcggcctggttcctaataggccatggacccccacagacgggtactagtctgcagcctgtggaccccagccctaggggcctgccattctgagtgagttattagcatgaagaagaggaagatctggatcaaacgtgggtgatggtactcagagacccaagataggatagggatggaacaa

SEQ ID NO: 436849 - DNA, 1368 bp, Homo sapiens
  misc_feature (24)..(24): n is a, c, g, or t
  misc_feature (30)..(32): n is a, c, g, or t
aataaaataaagagaaaaagaaanatgagnnngcagggagagatgaccaacaagtacaaatacaaatagatggagctaagtatttaaaaaaactcgaactataaggatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatgaatggaaaagtatattctgtgttttaagtctctttaataaaaaacaaaacaaaatccaaaaaaactcctaacatggcaactcaggacattttaatccttttttttgttgttgggcttctgataggatccattttattgattccataaatatttagtagactttagacatattaatacattgtagtttgagttaatttgcattaaattctgtttttttccccttaggtatagattgtctgttggaaaaatatattgcttgtggatttcttggggagtgggaaggtgaattatacctgttgtctctacagtccactaccttccacaccctagggcagtggtccccaaccttcttggcaccagggatcagtttcctggaagacaatttttctgtggatggtgtggggatggttttgggatggaactgtccacctcagatcatcaggcattagttaggctctcataacgagtgcgcagcctagatccctcacatgcacagttcacagtagggtttgcgctgctatgagaatctaaggctgccactgatctgacaggaggcagaactcaggtggcaatgcttactggcccactgctcacctcttgctgtgcggcctggttcctaataggccatggacccccacagacgggtactagtctgcagcctgtggaccccagccctaggggcctgccattctgagtgagttattagcatgaagaagaggaagatctggatcaaacgtgggtgatggtactcagagacccaagataggatagggatggaacaa

SEQ ID NO: 436850 - DNA, 1330 bp, Homo sapiens
  misc_feature (1)..(1): n is a, c, g, or t
  misc_feature (16)..(19): n is a, c, g, or t
  misc_feature (24)..(24): n is a, c, g, or t
  misc_feature (63)..(63): n is a, c, g, or t
naaaaaaaaaaaaaannnnaaaanaaaataaaaaaataaaatataaaaaaataaaaaaactantaaccatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatgaatggaaaagtatattctgtgttttaagtctctttaataaaaaacaaaacaaaatccaaaaaaactcctaacatggcaactcaggacattttaatccttttttttgttgttgggcttctgataggatccattttattgattccataaatatttagtagactttagacatattaatacattgtagtttgagttaatttgcattaaattctgtttttttccccttaggtatagattgtctgttggaaaaatatattgcttgtggatttcttggggagtgggaaggtgaattatacctgttgtctctacagtccactaccttccacaccctagggcagtggtccccaaccttcttggcaccagggatcagtttcctggaagacaatttttctgtggatggtgtggggatggttttgggatggaactgtccacctcagatcatcaggcattagttaggctctcataacgagtgcgcagcctagatccctcacatgcacagttcacagtagggtttgcgctgctatgagaatctaaggctgccactgatctgacaggaggcagaactcaggtggcaatgcttactggcccactgctcacctcttgctgtgcggcctggttcctaataggccatggacccccacagacgggtactagtctgcagcctgtggaccccagccctaggggcctgccattctgagtgagttattagcatgaagaagaggaagatctggatcaaacgtgggtgatggtactcagagacccaagataggatagggatggaacaa

SEQ ID NO: 436851 - DNA, 1469 bp, Homo sapiens
agttatttcttccactgacatcttgaacccctcagtcatccatgaggcttggaatcaacttcttccatatctcctgctcatgttgatattttgatctccttttatgaaacatggatgttttaatagcatctagaatgagaaatcttttccagaaggctttcaattgactttgcccagatccatcagaggaatcgctatctatgacggatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatgaatggaaaagtatattctgtgttttaagtctctttaataaaaaacaaaacaaaatccaaaaaaactcctaacatggcaactcaggacattttaatccttttttttgttgttgggcttctgataggatccattttattgattccataaatatttagtagactttagacatattaatacattgtagtttgagttaatttgcattaaattctgtttttttccccttaggtatagattgtctgttggaaaaatatattgcttgtggatttcttggggagtgggaaggtgaattatacctgttgtctctacagtccactaccttccacaccctagggcagtggtccccaaccttcttggcaccagggatcagtttcctggaagacaatttttctgtggatggtgtggggatggttttgggatggaactgtccacctcagatcatcaggcattagttaggctctcataacgagtgcgcagcctagatccctcacatgcacagttcacagtagggtttgcgctgctatgagaatctaaggctgccactgatctgacaggaggcagaactcaggtggcaatgcttactggcccactgctcacctcttgctgtgcggcctggttcctaataggccatggacccccacagacgggtactagtctgcagcctgtggaccccagccctaggggcctgccattctgagtgagttattagcatgaagaagaggaagatctggatcaaacgtgggtgatggtactcagagacccaagataggatagggatggaacaa

SEQ ID NO: 436852 - DNA, 1381 bp, Homo sapiens
ctcgtctggaaacactctcttaatgctccaccgctacaacatcaggtatcagaattcagacatggagggctcaatggtgtcccctggtctttggaacattctgtattttaatgatcatgatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatgaatggaaaagtatattctgtgttttaagtctctttaataaaaaacaaaacaaaatccaaaaaaactcctaacatggcaactcaggacattttaatccttttttttgttgttgggcttctgataggatccattttattgattccataaatatttagtagactttagacatattaatacattgtagtttgagttaatttgcattaaattctgtttttttccccttaggtatagattgtctgttggaaaaatatattgcttgtggatttcttggggagtgggaaggtgaattatacctgttgtctctacagtccactaccttccacaccctagggcagtggtccccaaccttcttggcaccagggatcagtttcctggaagacaatttttctgtggatggtgtggggatggttttgggatggaactgtccacctcagatcatcaggcattagttaggctctcataacgagtgcgcagcctagatccctcacatgcacagttcacagtagggtttgcgctgctatgagaatctaaggctgccactgatctgacaggaggcagaactcaggtggcaatgcttactggcccactgctcacctcttgctgtgcggcctggttcctaataggccatggacccccacagacgggtactagtctgcagcctgtggaccccagccctaggggcctgccattctgagtgagttattagcatgaagaagaggaagatctggatcaaacgtgggtgatggtactcagagacccaagataggatagggatggaacaa

SEQ ID NO: 436853 - DNA, 1302 bp, Homo sapiens
  misc_feature (37)..(37): n is a, c, g, or t
ggggaaagtcacgaccttgctgagtcagaataaccgntacatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatgaatggaaaagtatattctgtgttttaagtctctttaataaaaaacaaaacaaaatccaaaaaaactcctaacatggcaactcaggacattttaatccttttttttgttgttgggcttctgataggatccattttattgattccataaatatttagtagactttagacatattaatacattgtagtttgagttaatttgcattaaattctgtttttttccccttaggtatagattgtctgttggaaaaatatattgcttgtggatttcttggggagtgggaaggtgaattatacctgttgtctctacagtccactaccttccacaccctagggcagtggtccccaaccttcttggcaccagggatcagtttcctggaagacaatttttctgtggatggtgtggggatggttttgggatggaactgtccacctcagatcatcaggcattagttaggctctcataacgagtgcgcagcctagatccctcacatgcacagttcacagtagggtttgcgctgctatgagaatctaaggctgccactgatctgacaggaggcagaactcaggtggcaatgcttactggcccactgctcacctcttgctgtgcggcctggttcctaataggccatggacccccacagacgggtactagtctgcagcctgtggaccccagccctaggggcctgccattctgagtgagttattagcatgaagaagaggaagatctggatcaaacgtgggtgatggtactcagagacccaagataggatagggatggaacaa

SEQ ID NO: 436854 - DNA, 1332 bp, Homo sapiens
  misc_feature (9)..(9): n is a, c, g, or t
gtgttgttngtgttggggtttgtggcctgtacaatcgtgaagcgggaatgtcagggtgcccgtttcggccatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatgaatggaaaagtatattctgtgttttaagtctctttaataaaaaacaaaacaaaatccaaaaaaactcctaacatggcaactcaggacattttaatccttttttttgttgttgggcttctgataggatccattttattgattccataaatatttagtagactttagacatattaatacattgtagtttgagttaatttgcattaaattctgtttttttccccttaggtatagattgtctgttggaaaaatatattgcttgtggatttcttggggagtgggaaggtgaattatacctgttgtctctacagtccactaccttccacaccctagggcagtggtccccaaccttcttggcaccagggatcagtttcctggaagacaatttttctgtggatggtgtggggatggttttgggatggaactgtccacctcagatcatcaggcattagttaggctctcataacgagtgcgcagcctagatccctcacatgcacagttcacagtagggtttgcgctgctatgagaatctaaggctgccactgatctgacaggaggcagaactcaggtggcaatgcttactggcccactgctcacctcttgctgtgcggcctggttcctaataggccatggacccccacagacgggtactagtctgcagcctgtggaccccagccctaggggcctgccattctgagtgagttattagcatgaagaagaggaagatctggatcaaacgtgggtgatggtactcagagacccaagataggatagggatggaacaa

SEQ ID NO: 436855 - DNA, 613 bp, Homo sapiens
  misc_feature (563)..(564): n is a, c, g, or t
gtaatctgcaacgactctcttaatcctccacggctacacgtgaaacagtcgcaaatggaatttcaagaaacattctatatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatggatgnncccggaactttttaccgtttaccgtacccgcccgcaccccccacacaca

SEQ ID NO: 436856 - DNA, 615 bp, Homo sapiens
gtaatctgcaacgactctcttaatcctccacggctacacgtgaaacagtcgcaaatggaatttcaagaaacattctatatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatgcgatgcgaccggagaattacaatataaattaggagtgctagatgtggggaggatggg

SEQ ID NO: 436857 - DNA, 621 bp, Homo sapiens
  misc_feature (561)..(561): n is a, c, g, or t
gtaatctgcaacgactctcttaatcctccacggctacacgtgaaacagtcgcaaatggaatttcaagaaacattctatatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatgggngtcgcgccgcaagcccctctataaatttggaaaacgatgtgcgcatatcaaaatcatcat

SEQ ID NO: 436858 - DNA, 619 bp, Homo sapiens
  misc_feature (567)..(567): n is a, c, g, or t
gtaatctgcaacgactctcttaatcctccacggctacacgtgaaacagtcgcaaatggaatttcaagaaacattctatatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatgaacccagangcggccgaacatcactctctcgcacgatttggttcggtgatcgtcgggagga

SEQ ID NO: 436859 - DNA, 761 bp, Homo sapiens
gtaatctgcaacgactctcttaatcctccacggctacacgtgaaacagtcgcaaatggaatttcaagaaacattctatatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatggtaaaaacaagaatacaaatattatatcgcacccctattatccgagggagacacataaaatacaacgcgctcgtcggccctcgcggggaaactttgccggcgcttcccttttgggaggggaaatttaagatccttcgctcatgagctcgctgcgcttcgtcgtaccagctagggggagcggtattcacttactattagggggt

SEQ ID NO: 436860 - DNA, 612 bp, Homo sapiens
gtaatctgcaacgactctcttaatcctccacggctacacgtgaaacagtcgcaaatggaatttcaagaaacattctatatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatgggatgcggcctaattttttgttttttgtaataaatgaataacataaccgaccgg

SEQ ID NO: 436861 - DNA, 609 bp, Homo sapiens
gtaatctgcaacgactctcttaatcctccacggctacacgtgaaacagtcgcaaatggaatttcaagaaacattctatatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatgtacccgatgcggccgaagccacacttctaaaatcttgattaatgcaggtgc

SEQ ID NO: 436862 - DNA, 798 bp, Homo sapiens
gtttttatattaaccacggattcagctaaggagaggccccggatcaggacagcagtttcctcagacgtgatgtggtgccccttgcatcctgctcagagaattctcagcagcacagatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatggtaaaaacaagaatacaaatattatatcgcacccctattatccgagggagacacataaaatacaacgcgctcgtcggccctcgcggggaaactttgccggcgcttcccttttgggaggggaaatttaagatccttcgctcatgagctcgctgcgcttcgtcgtaccagctagggggagcggtattcacttactattagggggt

SEQ ID NO: 436863 - DNA, 711 bp, Homo sapiens
gtaatctgcaacgactctcttaatcctccacggctacacgtgaaacagtcgcaaatggaatttcaagaaacattctatcatcaggtattatctactgctgtctgcagaattcagacatggagggctcaatggtgtcccctggtctttggaacattctgtattttaatgatcatgatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatgcgatgcgaccggagaattacaatataaattaggagtgctagatgtggggaggatggg

SEQ ID NO: 436864 - DNA, 1764 bp, Homo sapiens
tccatgctgccctcatgggggctttcctacctagctgatgtttgaagttttcatgtgtgcctctgtctttgacccacctggctagttcagagcctttgctgaagaaaatgttctttgcttgtccgattgcttcacagcacgcttctctatctgcaactgttgtttcccagccatccatatggtgccacaggatgggacacaggcagggactttactattcacaaaggggtagggcctgggacctcgagtggggcttttcctgcttataaagacaaggaatgaaaatgcagaatccttacctggtaggggaactttcttttccaaatatgcaggtatgtatatttctgatttccttaggcttggatctgtgcctgggggtgagatggatttcaaagtcattatttaaagtagggagataaagctttagacaaccaccataagagatcctggttgtatttttgaaatgttgagcgaaataacattttagtgatcagtaaaagctaacctttgtacttctgaaaagttgttcttagaaaggcctggattaataattggtttcaatttgcccacagatatacactgcctctaggactgggacagatagccactgagtacctgcttcaaatcaccctgcacgttttctctttggaaagataagcactggagaaccatctcgttaccttcagcagaaatggaaacaaagcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatgaatggaaaagtatattctgtgttttaagtctctttaataaaaaacaaaacaaaatccaaaaaaactcctaacatggcaactcaggacattttaatccttttttttgttgttgggcttctgataggatccattttattgattccataaatatttagtagactttagacatattaatacattgtagtttgagttaatttgcattaaattctgtttttttccccttaggtatagattgtctgttggaaaaatatattgcttgtggatttcttggggagtgggaaggtgaattatacctgttgtctctacagtccactaccttccacaccctagggcagtggtccccaaccttcttggcaccagggatcagtttcctggaagacaatttttctgtggatggtgtggggatggttttgggatggaactgtccacctcagatcatcaggcattagttaggctctcataacgagtgcgcagcctagatccctcacatgcacagttcacagtagggtttgcgctgctatgagaatctaaggctgccactgatctgacaggaggcagaactcaggtggcaatgcttactggcccactgctcacctcttgctgtgcggcctggttcctaataggccatggacccccacagacgggtactagtctgcagcctgtggaccccagccctaggggcctgccattctgagtgagttattagcatgaagaagaggaagatctggatcaaacgtgggtgatggtactcagagacccaagataggatagggatggaacaa

SEQ ID NO: 436865 - DNA, 1809 bp, Homo sapiens
gtaatctgcaacgactctcttaatcctccacggctacacgtgaaacagtcgcaaatggaatttcaagaaacattctatcatcaggtattatctactgctgtctgcagaattcagacatggagggctcaatggtgtcccctggtctttggaacattctgtattttaatgatcatgccttacacagcttgtagaatccatcacttcaacagagcagactgaattacttcgatgactggcaaatgggcaccacttgtggtgaaatgaaagcagtcagatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtacatggagggctcaatggtgccccctggtctttggaacattctgtattctaatgatcatgccttacacagcttgtagaatccatcacttcaacagagcagactgaattacttccatgactggcaaatgggcaccacttgcggtgaaaggaaagcagtcagatacactgcctctaggactgggacagatagccactgagtacctgcttcaaatcaccctgcacgttttttttttggtaagataagcactggagaaccatttcgtacctttagcagcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatgaatggaaaagtatattctgtgttttaagtctctttaataaaaaacaaaacaaaatccaaaaaaactcctaacatggcaactcaggacattttaatccttttttttgttgttgggcttctgataggatccattttattgattccataaatatttagtagactttagacatattaatacattgtagtttgagttaatttgcattaaattctgtttttttccccttaggtatagattgtctgttggaaaaatatattgcttgtggatttcttggggagtgggaaggtgaattatacctgttgtctctacagtccactaccttccacaccctagggcagtggtccccaaccttcttggcaccagggatcagtttcctggaagacaatttttctgtggatggtgtggggatggttttgggatggaactgtccacctcagatcatcaggcattagttaggctctcataacgagtgcgcagcctagatccctcacatgcacagttcacagtagggtttgcgctgctatgagaatctaaggctgccactgatctgacaggaggcagaactcaggtggcaatgcttactggcccactgctcacctcttgctgtgcggcctggttcctaataggccatggacccccacagacgggtactagtctgcagcctgtggaccccagccctaggggcctgccattctgagtgagttattagcatgaagaagaggaagatctggatcaaacgtgggtgatggtactcagagacccaagataggatagggatggaacaa

SEQ ID NO: 436866 - DNA, 1793 bp, Homo sapiens
tccatgctgccctcatgggggctttcctacctagctgatgtttgaagttttcatgtgtgcctctgtctttgacccacctggctagttcagagcctttgctgaagaaaatgttctttgcttgtccgattgcttcacagcacgcttctctatctgcaactgttgtttcccagccatccatatggtgccacaggatgggacacaggcagggactttactattcacaaaggggtagggcctgggacctcgagtggggcttttcctgcttataaagacaaggaatgaaaatgcagaatccttacctggtaggggaactttcttttccaaatatgcaggtatgtatatttctgatttccttaggcttggatctgtgcctgggggtgagatggatttcaaagtcattatttaaagtagggagataaagctttagacaaccaccataagagatcctggttgtatttttgaaatgttgagcgaaataacattttagtgatcagtaaaagctaacctttgtacttctgaaaagttgttcttagaaaggcctggattaataattggtttcaatttgcccacagatatacactgcctctaggactgggacagatagccactgagtacctgcttcaaatcaccctgcacgttttctctttggaaagataagcactggagaaccatctcgttactcaagacattaagaatgccgcagtggacagcagttatgcaaggttcagcagaggaagttttcaagatggtgtaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatgaatggaaaagtatattctgtgttttaagtctctttaataaaaaacaaaacaaaatccaaaaaaactcctaacatggcaactcaggacattttaatccttttttttgttgttgggcttctgataggatccattttattgattccataaatatttagtagactttagacatattaatacattgtagtttgagttaatttgcattaaattctgtttttttccccttaggtatagattgtctgttggaaaaatatattgcttgtggatttcttggggagtgggaaggtgaattatacctgttgtctctacagtccactaccttccacaccctagggcagtggtccccaaccttcttggcaccagggatcagtttcctggaagacaatttttctgtggatggtgtggggatggttttgggatggaactgtccacctcagatcatcaggcattagttaggctctcataacgagtgcgcagcctagatccctcacatgcacagttcacagtagggtttgcgctgctatgagaatctaaggctgccactgatctgacaggaggcagaactcaggtggcaatgcttactggcccactgctcacctcttgctgtgcggcctggttcctaataggccatggacccccacagacgggtactagtctgcagcctgtggaccccagccctaggggcctgccattctgagtgagttattagcatgaagaagaggaagatctggatcaaacgtgggtgatggtactcagagacccaagataggatagggatggaacaa

SEQ ID NO: 436867 - DNA, 1272 bp, Homo sapiens
  misc_feature (28)..(28): n is a, c, g, or t
ctcagtctggacgactctcttaatctcncaccgctacacgtgaaactcaagaaacattctatatacactgcctctaggactgggacagatagccactgagtacctgcttcaaatcaccctgcacataagcactggagaaccatctcgttaccttcagcagaaatggaaacaaatcaagacattaagaatgccgcagtggacagcagttatgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatgaatggaaaagtatattctgtgttttaagtctctttaataaaaaacaaaacaaaatccaaaaaaactcctaacatggcaactcaggacattttaatccttttttttgttgttgggcttctgataggatccattttattgattccataaatatttagtagactttagacatattaatacattgtagtttgagttaatttgcattaaattctgtttttttccccttaggtatagattgtctgttggaaaaatatattgcttgtggatttcttggggagtgggaaggtgaattatacctgttgtctctacagtccactaccttccacaccctagggcagtggtccccaaccttcttggcaccagggatcagtttcctggaagacaatttttctgtggatggtgtggggatggttttgggatggaactgtccacctcagatcatcaggcattagttaggctctcataacgagtgcgcagcctagatccctcacatgcacagttcacagtagggtttgcgctgctatgagaatctaaggctgccactgatctgacaggaggcagaactcaggtggcaatgcttactggcccactgctcacctcttgctgtgcggcctggttcctaataggccatggacccccacagacgggtactagtctgcagcctgtggaccccagccctaggggcctgccattctgagtgagttattagcatgaagaagaggaagatctggatcaaacgtgggtgatggtactcagagacccaagataggatagggatggaacaa

SEQ ID NO: 436868 - DNA, 1065 bp, Homo sapiens
tccatgctgccctcatgggggctttcctacctagctgatgtttgaagttttcatgtgtgcctctgtctttgacccacctggctagttcagagcctttgctgaagaaaatgttctttgcttgtccgattgcttcacagcacgcttctctatctgcaactgttgtttcccagccatccatatggtgccacaggatgggacacaggcagggactttactattcacaaaggggtagggcctgggacctcgagtggggcttttcctgcttataaagacaaggaatgaaaatgcagaatccttacctggtaggggaactttcttttccaaatatgcaggtatgtatatttctgatttccttaggcttggatctgtgcctgggggtgagatggatttcaaagtcattatttaaagtagggagataaagctttagacaaccaccataagagatcctggttgtatttttgaaatgttgagcgaaataacattttagtgatcagtaaaagctaacctttgtacttctgaaaagttgttcttagaaaggcctggattaataattggtttcaatttgcccacagatatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaattcccccatacccctccaagctcactccccaacccccaactcggtgtggtaagcaacatggctttgatgataaacggctttactct

SEQ ID NO: 436869 - DNA, 532 bp, Homo sapiens
gagacgcaggtcagaatggaaatgggctgcagaccgggcagctattgtcagccgctggaactggcttcaggctcatgtttctgacttggaatatcgaattcgtcagcaaacagacatttacaaacagatacgtgctaataaggtaagggataagtatctgatgtttttaaatgctgccgaaaactatcaatatcgctggtctcaaactcttgacctcaagtgatcctccttgccttggcctcccagaagcactggcttgactcttacgttgttttttaaaatctcctcttctgactactctttgagattacacagctgtagctgaggatggaaatgttattgaggatgggaggtggaagagcattgaaacttttgaatagggaaggagttgaatgggaactgcagaagcttataacacctttctcttcaaaattttcataaagctgtaactggagctgttgtaactcgagctgttgtaactggcgctgttgtaactggggctgttgtaactggagctgttgtaactggagct

SEQ ID NO: 436870 - DNA, 663 bp, Homo sapiens
gagacgcaggtcagaatggaaatgggctgcagaccgggcagctattgtcagccgctggaactggcttcaggctcatgtttctgacttggaatatcgaattcgtcagcaaacagacatttacaaacagatacgtgctaataaggtaagggataagtatctgatgtttttaaatgctgccgaaaactatcaatatcgctggtctcaaactcttgacctcaagtgatcctccttgccttggcctcccagaagcactggcttgactcttacgttgttttttaaaatctcctcttctgactactctttgagattacacagctgtagctgaggatggaaatgttattgaggatgggaggtggaagagcattgaaacttttgaatagggaaggagttgaatgggaactgcagaagcttataacacctttctcttcaaaattttcataaagctgttgaagttctcatcttaatagggttttttaaagcactttagacaacttatcttttccaggtagcccagggtgattcttgtggaactggtctgcagtggggtcactggtttgtcttgagatgcatagggaagattgacctgatagagtgatgtaaggaagtatgtgaaattgcctgttagctgtattgcaaatacagttgagagagggttcatccaca

SEQ ID NO: 436871 - DNA, 328 bp, Homo sapiens
gagacgcaggtcagaatggaaatgggctgcagaccgggcagctattgtcagccgctggaactggcttcaggctcatgtttctgacttggaatatcgaattcgtcagcaaacagacatttacaaacagatacgtgctaataaggggttgatagttcttggggaggtacctcccccagagcatacaacagacttatttcttccacttagttctgaggtgaagacagatcatgggactgataaattgattgagtctgtttctcagccattggaaaaccatggtgcccctattattggtcatatttcagagtcactgtctaccaaatcatgt

SEQ ID NO: 436872 - DNA, 2522 bp, Homo sapiens
  misc_feature (14)..(14): n is a, c, g, or t
gatatattcaagangttaacatacctattctaaaagatcttttaaagtttggttccttcttgaatatatcttttagaataggtatgttaacttctcatcctaaccctatcaatatatcagaggctttatgaaggagactctacagataaccacaaatcttatcaagaaaattctccttaaaaaaagttatcctttattttgttgttaaatttcccagtttttaaaagtgttttatcaaaatgacttcataattgaagcaaataccttttggaagtatatatgttacataagactttcactaaatctgtgcgtaaagcttttataatctgagatattgttatgtattaggtttgtgcaaacctaatataaaagggttcatctgtaagtatcatttagaggcaaaataatttccccctcacatctaatgtggactcaaattttggcaactggaatgttatcctcttggtaggcattctaaattaatgaatactgctatgtggtgtagtaaacaaatttgccataaaatgccatttaaggattttctttttacctttatttcattataaaagtatatgagttgaagatcatataaaaaatatgaaactcctacacaggaaatccccaattttgtgatttaataggttgtaaaaagagttgttccaaattcagactacatctcatcatataaataatattatgaataataagggtaaaagattagccaacaaaagctaatctagtacaccccatagaggtactccaggtgtcttggttttggataaatttttatagtggagaaaggttactttgatctctcaataattgcttggtacacttcttcctaggcaatatgctcatgataccctcttcatgtgacctattcctcaaatgctgcattctccaaaacttccttacctgccttctatcccctagtcattcttatcaatacttccaaaatataacctatctcaagtgttagaaatttgctttaactaatttatattaaagtgttagtgactatagcccttttatctctcttaaagagaaatctgcattaaaagcaaacacattgctgttagctcaaattaatgtcagtgagtagaatcttaagctttaaaacaaaagtggaaataatttaaattagtgttgatgggactattttgaggcaagagataccattaagtgacctagcttggaaatctgccccctttgcccaaacccatgtgatgtctgaaactactgtatattttcaatgaccttgagaaagggagctagtcatttgtatttatgggccttatgaagtcagggcctgctgatcctgttttttaagttcaagcgcaatgcctgaagcatcctagatctccttcaccctcattctacctgacagacagctaggtctgtcttccagctctttctcattgatactacctttacataagaatactatccatgcttgttaaaaaaaaaaaaagtctttccccattttactgttacaatttttcaagagctataaaggtagaaaaagtattccttttcattattctaaaaaatatgtcatttttaaatagctggcacttagcagtttagttttccaaactttattctgaatcaaattgctgaggtgattctaaatgtctaatgttgatttatcatataaacatctaattagaaagtgtttatgctaaagacttgtattttgtggcattagttcttcatgtttcttttttatatgtttattaaaattgttcacttccaaatgagtggaaaagttgctgttgttgggatgtacagggcaagtgcacttggttagagcatgaactgggaatttcacattctctgatgtgctttgcactctgctcttgtagatttattttgtttacagtagactgatgtcagtttttgtaaatgttttttcttagcactttaactgtgagtgtacaaactgattttaaatgtagtggttgtatattttggttataaattggagatttttaataaaattaaataattctcttttctgtcattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaagaggagggggcgggccagacataaaaaagcaaccggacggcgggcgccgcctggcacagaacgcacacgactgagagaatgcagccacggcgaggccgacaaatagaagcgagagagatagaaaaagagaagaggcgcagggcggctggagagagactaagaaaacgacagggacgacggagaggggaaaagacgcaaagagagagcgggtgcgagaagggagaggaacagagcacagtcgggggtggtggtatgggacatcgaaagagagcacccagagcaagacgcagaaagaaagagcggggaggcaaggaaacagactggagcgagcgaggtgggagacaacgcagagcggacaggag

SEQ ID NO: 436873 - DNA, 368 bp, Homo sapiens
atgctagcaatttcataatagatatattcaagaaggaaccaaactttaaaagatcttttagaataggtatgttaacttctcatcctaaccctatcaatatatcagaggctttatgaaggagactctacagataaccacaaatcttatcaagaaaattctccttaaaaaaagttatcctttattttgttgttaaatttcccagtttttaaaagtgttttatcaaaatgacttcataattgaagcaaataccttttggaagtatatatgttacataagactttcactaaatctgtgcgtaaagcttttataatctgagatattgttatgtattaggtttgtgcaaacctaatataaaagggttcatctgt

SEQ ID NO: 436874 - DNA, 414 bp, Homo sapiens
cattaaaagcaaacacattgctgttagctcaaattaatgtcagtgagtagaatcttaagctttaaaacaaaagtggaaataatttaaattagtgttgatgggactattttgaggcaagagataccattaagtgacctagcttggaaatctgccccctttgcccaaacccatgtgatgtctgaaactactgtatattttcaatgaccttgagaaagggagctagtcatttgtatttatgggccttatgaagtcagggcctgctgatcctgttttttaagttcaagcgcaatgcctgaagcatcctagatctccttcaccctcattctacctgacagacagctaggtctgtcttccagctctttctcattgatactacctttacataagaatactatccatgcttgttaaaaaaaa

SEQ ID NO: 436875 - DNA, 852 bp, Homo sapiens
ttgagatggagtcttgctctgtcgctgggctagagtgcagtggtttgatcttggccactacaacctccacctcctgggttcaagtgattcgcctgcctcagccttctgagtacctgggaatataggcactcgccaccatgcccagctaattacttctgtcttgtattttaatcttctctgctctttagatgtttgaagtgaggccaggcatgttggctcacgcctgtaatcccagcactttcggaggccaaggtgggagaatcacttgaggctaggagttggagaccagcctgggcaacatagcaagactgcatctctacaaaaaaaaagaaaagattcttgaagtgaatgtatactcatttcctggttgtttctttctgtaaggatgtctgacccagctaatttgtaaacaggaattctgcactcatttctgtttttgcattctcaaccccagttgggcacacaagtgtttaatgagtatttaactgatttgataagaataaattcattgatttctttgaaaaaaaaaaaaaaaaacaaaaaaaaaaacttgtgggggggctggggccctgagaaaaggtttttcaacaccccttcggttggggctgccgggggccccccataagggttaagcgtcagaaccgtggggcactaggcgcgcttccccagaggagaaaatccgcggcgaagcaaactagtgcggcgtgggtttctcccccaccaataacaaaggagcgcgcgggggcagccccgaagcggttgtggaaacaatctccagagggggagtccgggagaggacaacagaggagccgatcacgcgggaggtccaacaggaaccggaaataaattagc

SEQ ID NO: 436876 - DNA, 866 bp, Homo sapiens
agggggtgtgtgtgaggctggagcggactggggagcccagacctgccgagcgacgtgggcgagcggtgacctggaccacggcgcagacgcgggcgagctgcggctcggacgccagcggacacgcgggcgagatcactttgggaagcagtgacatccaacctgtatcaagtcttctaatctgtgaacatgagatgggtctcggctgtgttacctaagctggagtgcagtggctattcccagcacaatcatagtgcactacagtctccaactcctgggttcaggtgctccttgtgcctccgcctcctgaatagctgggattgcaggcatgtgccatcatgcctggctatgtgccttcaaaaagactacagttgtggatggagtgttttatcaatattagttggtttatgattgtgtttagttccatatcctagctgattttctatctgttctgtccattcttgaagagtccaactataattttgagtttgtctatttctcctcaagttctgtcagttttgctgtatatatttgaggtctgtttttagatgtgtacacattttaaatggtgttgggtctttaccattatgtaatgtccctcttaatctattgtaaatttccttgctttgaggtatagtttgtcttatgtaaatataatcagttcagttttcctttgaccagcatttacgtaacatatctttttccatttttaaacttataatctacctatattaaaatatatagtcaggccaggtgcagcggctcatgcgtgtaatcccagcactttgggaggccgaggcaagcagatcacttgaggccaggagtttgagaccagcctgggcaacgtgacgaaaacctgtctctaccaa

SEQ ID NO: 436877 - DNA, 1271 bp, Homo sapiens
agggggtgtgtgtgaggctggagcggactggggagcccagacctgccgagcgacgtgggcgagcggtgacctggaccacggcgcagacgcgggcgagctgcggctcggacgccagcggacacgcgggcgagtgcgcggcctctccgtccaacgtgctcgttgccggcatctccagcgcccggccgtgccccgacggcctgacctggatcacttcctggccgcctccctgtccggcggctcccctcggtccggctcccacttccccgtccaggatgctggctccgaagcaacatctgtggtcgcgcgggacccatcccaggacctccccggaacgcgccgggatgggacgctcggacccagaccacagcccccggccgcggcagggcgccgggatttgatcccgcgtcgccctggggggacagaagcgtcccggagttgggaggggatttgaagcctatggtcctgacttccaccccgtggctgagggcgaggctgcggggccggggttaggagcagaagtccctatttccgaaccgtctgggaggagagccgggggatgcccatcacggcagtttagggagagagagggaaggactctgccgctttggaggctaggtcataggcagctggcggtgtctcagcgcgagtgaccaatccttgtggttgggaaatgtgtcgtgggcgtccgtgggctcgttttgcctttgagattaaataggaaattttcccaggacgagtttaccggagcaccttgggagttggtttttggcttggagagctactttcccctctctaaatctaaaactgctttgtttttccttattatttttttcgagatgggatctcacaatgttacccaggcaggtgtcaaactcctggccttaagcgatcctcccgcctcggcctcccagagtgctgggattagagacgtgagccattgcgcggctttaactgctgttagtctgttccttaaaattgttgtaccaggaaacttgccagagatgcaagaagatgtgattatattgttaacatttaatgataaataacattttgcttttaagagttactgattcatatcctcaagattaagaaatgttcaggatatgaatatttaatgacctttccaatcagtcagtttctgctctctagaagttagccagttgaggagaagggacagtcaagatactttcagaacagtgtggtaaggagtgtgagctaagatggagcaccgaggaaggagccgggcatttaggccatgctgttgggtgtgg

SEQ ID NO: 436878 - DNA, 4639 bp, Homo sapiens
gcattcaggacgcagaggaattagtatttactgtttttaacattccttacatgggaatcacgtaaagaatcaggtaaacaggattcaatttgtgactcaaccattaatactttgtgacactggctaatttatttcacttctggatgtcggttatgttttttttgagacaggatctcgctctgctgtcacccggcctggagttcagtggagggatctctgcaccgtcaacttcctgggctatcaagcgatcctcccacctcagcctccctggtagttgggaccacaggtgcccgccatcatgtccggctgatttgtaaaatttcttttgtagagatggtgaccttgctctgtggcccaggctggtctcgaactcctggactcaagcgatcctcctgcctgggcctcctaaagattcagctgcttttggatcaaccgatcgccttaagaccttttaactcgaacacctgtcacatcctaggatccgcgaaggactgaaacagagtttctgaagcgtccctcggcgcagtagctccgctccacctcccattcgcgctaccaccgcggccgcagccccaggagtcgccgcggagccagcgtcgccctccagctgttgcgcgtcggaagccggaagcagggactgagcgacagactaggaaacgccggtttctccggggctccccagcgccccacctttaccccggaggccgccctcttccatttgctcttgggcgtcagggcggtaccccactccgctcgaccctttggatccgctcgcacttcctcccgtccagagtcaaaggccccggaagtgacgtttacgcgccgcgcgtaaacgtgcgttcgctggcggtgccgggggcggggcgagcaggagggtgggtgtgaggcgggagctggccgcggagcccagacctacccgggcgaagcgggcgagcggtggtttggacgccggcggagacgcgggcgagtggttagcaggaagaagatgagccttaagtctgaacgccgaggaattcatgtggatcaatcggatctcctgtgcaagaaaggatgtggttactacggcaaccctgcctggcagggtttctgctccaagtgctggagggaagagtaccacaaagccaggcagaagcagattcaggaggactgggagctggcggagcgactccagcgggaggaagaagaggcctttgccagcagtcagagcagccaaggggcccaatccctcacattctccaagtttgaagaaaagaaaaccaacgagaagacccgcaaggttaccacagtgaagaaattcttcagtgcatcttccagggtcggatcaaagaaggaaattcaggaagcaaaagctcccagtccttccataaaccggcaaaccagcattgaaacggatagagtgtctaaggagttcatagaatttctcaagaccttccacaagacaggccaagaaatctataaacagaccaagctgtttttggaaggaatgcattacaaaagggatctaagcattgaagaacagtcagagtgtgctcaggatttctaccacaatgtggccgaaaggatgcaaactcgtgggaaagtgcctccagaaagagtcgagaagataatggatcagattgaaaagtacatcatgactcgtctctataaatatgtattctgtccagaaactactgatgatgagaagaaagatcttgccattcaaaagagaatcagagccctgcgctgggttacgcctcagatgctgtgtgtccctgttaatgaagacatcccagaagtgtctgatatggtggtgaaggcgatcacagatatcattgaaatggattccaagcgtgtgcctcgagacaagctggcctgcatcaccaagtgcagcaagcacatcttcaatgccatcaagatcaccaagaatgagccggcgtcagcggatgacttcctccccaccctcatctacattgttttgaagggcaaccccccacgccttcagtctaatatccagtatatcacgcgcttctgcaatccaagccgactgatgactggagaggatggctactatttcaccaatctgtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagagcattttttaaaggtacagtatatggggattgtttcgtttttcctagcaggggaaccttagttaataataaaatactacttatttgagttactgatacagattcatttaaggcttgtgtgcaaattttgtctcaatcttttttccctccatgattttcctatgtgcttcctctggcattcactgtggttttggtaaataattgccttttaaaggattaaacaaatgaatgctacaaagtgtatgttcaagaaaattaaatggtaccactcttccacagtttggaataattttataattgtaaagatagaaattatattgataagtaaatatgtaaaattgtaaatatgtaaaaaaaagaatggtgtctgctgtgcatggcattttatatgttaattttttagtttaaaatgaagtatattgaatgtttgcctttagcaccattttatttggtttgtcccactaaaatgactcgagaagtgtttagacaaactccccttaagatgtgcactccatctttaagaacgtgttagccttaactttgaggttctatatagtcagagactatgacaccactaaggttcagaataaagtttaggccacataaaattgctgtttaatgtagtcgatggaagactttaaactatgcttctagcttatttttccctcattcattcagcaaatctctattgagttcttcagtgagaaggagcaggcactgggcctggaatggaaggcgggaatgaatgggcctctgatggtgagaggtgacggggtccctcagctgtgagatgcaaggggcgccttgcagcctccataatatacatttgactttgcaaacgtctagacatgttttctgaacctttttcaggacatttcaacctcgggactattcatattagtggcctgagaggtgtttgttgtggggccaccctgtgcatggtagaatgttcagcagcattcctgccatccatatccattaggtgccagtagcacccccgctagagctgtgaaaaattctctccagacatagtcagatgtctcctggggccatatcacccctccgttaagaaccactgatgtcttttacaaaccaggagttatcctcctggtggttaatatggtgtaaccaaagaatcttgcactcaatgcacagtgtgatgttaactaaaacgagttaaatatttaggaggcttgacagctacctgcattgtagaaccttttcttatctcagtggaaccttctataacctaaatataccattgatgattcttcttccattcagtgacatccacagattatgcagctatacttgtgaaatcgtgcatgaggccccagggcaccgttctagaacaacgtcacttcacacaggcagctgagaaaggttctcttgcttttccagtatcttcctaaggatggagcccaaaattgcagagcagtaactttggaataaaaccagggtgggtataaaacttcttattcttaaatttacatataagatctattaagcttgacacatctgtgtcatcacgcactgaagacaggaagcagttcactgagtcagctggttcccaagctcgcacagaaggtgataagttactatcaaatgccagtgagaatcttcttatagaataacctgggcccaagtgattttagtacaaaacttgcccttctttggtttaattttctatgtgcttttaggtgtgaatccagatatgcggtcttaattcctttggaaatacacagttcgtttagttactgtacactctgtttgttcaataaactgcatatcaacttcccacaaaagctgacttttttgggtctcttacatataaagtaggttattgagttgatttttttggaggtatctcatattggtcgaattcttctggtatggactcttgccttatatagaggcttctatttctcttaagtcagcatcaatacaacggccggagtttctgtttttgcaataagaagatgttggtattttatgtagggtaaatgtgactggaatacacctttggaacggaattctttatcaataaagtttcacaatccgtccctcttcca

SEQ ID NO: 436879 - DNA, 4834 bp, Homo sapiens
gcattcaggacgcagaggaattagtatttactgtttttaacattccttacatgggaatcacgtaaagaatcaggtaaacaggattcaatttgtgactcaaccattaatactttgtgacactggctaatttatttcacttctggatgtcggttatgttttttttgagacaggatctcgctctgctgtcacccggcctggagttcagtggagggatctctgcaccgtcaacttcctgggctatcaagcgatcctcccacctcagcctccctggtagttgggaccacaggtgcccgccatcatgtccggctgatttgtaaaatttcttttgtagagatggtgaccttgctctgtggcccaggctggtctcgaactcctggactcaagcgatcctcctgcctgggcctcctaaagattcagctgcttttggatcaaccgatcgccttaagaccttttaactcgaacacctgtcacatcctaggatccgcgaaggactgaaacagagtttctgaagcgtccctcggcgcagtagctccgctccacctcccattcgcgctaccaccgcggccgcagccccaggagtcgccgcggagccagcgtcgccctccagctgttgcgcgtcggaagccggaagcagggactgagcgacagactaggaaacgccggtttctccggggctccccagcgccccacctttaccccggaggccgccctcttccatttgctcttgggcgtcagggcggtaccccactccgctcgaccctttggatccgctcgcacttcctcccgtccagagtcaaaggccccggaagtgacgtttacgcgccgcgcgtaaacgtgcgttcgctggcggtgccgggggcggggcgagcaggagggtgggtgtgaggcgggagctggccgcggagcccagacctacccgggcgaagcgggcgagcggtggtttggacgccggcggagacgcgggcgagaaaactgtggatttagttactccactctgccatgtctttccaccactgcctgcacatttgagaccaaggatagagattgggaaaaattgatagttctcctgcctcagagtttggctcctgcactctcatttcagccatagctgcagacaaagcacacgattgctgggcactgtggctcaagagaaggaggagatgtggttagcaggaagaagatgagccttaagtctgaacgccgaggaattcatgtggatcaatcggatctcctgtgcaagaaaggatgtggttactacggcaaccctgcctggcagggtttctgctccaagtgctggagggaagagtaccacaaagccaggcagaagcagattcaggaggactgggagctggcggagcgactccagcgggaggaagaagaggcctttgccagcagtcagagcagccaaggggcccaatccctcacattctccaagtttgaagaaaagaaaaccaacgagaagacccgcaaggttaccacagtgaagaaattcttcagtgcatcttccagggtcggatcaaagaaggaaattcaggaagcaaaagctcccagtccttccataaaccggcaaaccagcattgaaacggatagagtgtctaaggagttcatagaatttctcaagaccttccacaagacaggccaagaaatctataaacagaccaagctgtttttggaaggaatgcattacaaaagggatctaagcattgaagaacagtcagagtgtgctcaggatttctaccacaatgtggccgaaaggatgcaaactcgtgggaaagtgcctccagaaagagtcgagaagataatggatcagattgaaaagtacatcatgactcgtctctataaatatgtattctgtccagaaactactgatgatgagaagaaagatcttgccattcaaaagagaatcagagccctgcgctgggttacgcctcagatgctgtgtgtccctgttaatgaagacatcccagaagtgtctgatatggtggtgaaggcgatcacagatatcattgaaatggattccaagcgtgtgcctcgagacaagctggcctgcatcaccaagtgcagcaagcacatcttcaatgccatcaagatcaccaagaatgagccggcgtcagcggatgacttcctccccaccctcatctacattgttttgaagggcaaccccccacgccttcagtctaatatccagtatatcacgcgcttctgcaatccaagccgactgatgactggagaggatggctactatttcaccaatctgtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagagcattttttaaaggtacagtatatggggattgtttcgtttttcctagcaggggaaccttagttaataataaaatactacttatttgagttactgatacagattcatttaaggcttgtgtgcaaattttgtctcaatcttttttccctccatgattttcctatgtgcttcctctggcattcactgtggttttggtaaataattgccttttaaaggattaaacaaatgaatgctacaaagtgtatgttcaagaaaattaaatggtaccactcttccacagtttggaataattttataattgtaaagatagaaattatattgataagtaaatatgtaaaattgtaaatatgtaaaaaaaagaatggtgtctgctgtgcatggcattttatatgttaattttttagtttaaaatgaagtatattgaatgtttgcctttagcaccattttatttggtttgtcccactaaaatgactcgagaagtgtttagacaaactccccttaagatgtgcactccatctttaagaacgtgttagccttaactttgaggttctatatagtcagagactatgacaccactaaggttcagaataaagtttaggccacataaaattgctgtttaatgtagtcgatggaagactttaaactatgcttctagcttatttttccctcattcattcagcaaatctctattgagttcttcagtgagaaggagcaggcactgggcctggaatggaaggcgggaatgaatgggcctctgatggtgagaggtgacggggtccctcagctgtgagatgcaaggggcgccttgcagcctccataatatacatttgactttgcaaacgtctagacatgttttctgaacctttttcaggacatttcaacctcgggactattcatattagtggcctgagaggtgtttgttgtggggccaccctgtgcatggtagaatgttcagcagcattcctgccatccatatccattaggtgccagtagcacccccgctagagctgtgaaaaattctctccagacatagtcagatgtctcctggggccatatcacccctccgttaagaaccactgatgtcttttacaaaccaggagttatcctcctggtggttaatatggtgtaaccaaagaatcttgcactcaatgcacagtgtgatgttaactaaaacgagttaaatatttaggaggcttgacagctacctgcattgtagaaccttttcttatctcagtggaaccttctataacctaaatataccattgatgattcttcttccattcagtgacatccacagattatgcagctatacttgtgaaatcgtgcatgaggccccagggcaccgttctagaacaacgtcacttcacacaggcagctgagaaaggttctcttgcttttccagtatcttcctaaggatggagcccaaaattgcagagcagtaactttggaataaaaccagggtgggtataaaacttcttattcttaaatttacatataagatctattaagcttgacacatctgtgtcatcacgcactgaagacaggaagcagttcactgagtcagctggttcccaagctcgcacagaaggtgataagttactatcaaatgccagtgagaatcttcttatagaataacctgggcccaagtgattttagtacaaaacttgcccttctttggtttaattttctatgtgcttttaggtgtgaatccagatatgcggtcttaattcctttggaaatacacagttcgtttagttactgtacactctgtttgttcaataaactgcatatcaacttcccacaaaagctgacttttttgggtctcttacatataaagtaggttattgagttgatttttttggaggtatctcatattggtcgaattcttctggtatggactcttgccttatatagaggcttctatttctcttaagtcagcatcaatacaacggccggagtttctgtttttgcaataagaagatgttggtattttatgtagggtaaatgtgactggaatacacctttggaacggaattctttatcaataaagtttcacaatccgtccctcttcca

SEQ ID NO: 436880 - DNA, 4418 bp, Homo sapiens
gcattcaggacgcagaggaattagtatttactgtttttaacattccttacatgggaatcacgtaaagaatcaggtaaacaggattcaatttgtgactcaaccattaatactttgtgacactggctaatttatttcacttctggatgtcggttatgttttttttgagacaggatctcgctctgctgtcacccggcctggagttcagtggagggatctctgcaccgtcaacttcctgggctatcaagcgatcctcccacctcagcctccctggtagttgggaccacaggtgcccgccatcatgtccggctgatttgtaaaatttcttttgtagagatggtgaccttgctctgtggcccaggctggtctcgaactcctggactcaagcgatcctcctgcctgggcctcctaaagattcagctgcttttggatcaaccgatcgccttaagaccttttaactcgaacacctgtcacatcctaggatccgcgaaggactgaaacagagtttctgaagcgtccctcggcgcagtagctccgctccacctcccattcgcgctaccaccgcggccgcagccccaggagtcgccgcggagccagcgtcgccctccagctgttgcgcgtcggaagccggaagcagggactgagcgacagactaggaaacgccggtttctccggggctccccagcgccccacctttaccccggaggccgccctcttccatttgctcttgggcgtcagggcggtaccccactccgctcgaccctttggatccgctcgcacttcctcccgtccagagtcaaaggccccggaagtgacgtttacgcgccgcgcgtaaacgtgcgttcgctggcggtgccgggggcggggcgagcaggagggtgggtgtgaggcgggagctggccgcggagcccagacctacccgggcgaagcgggcgagcggtggtttggacgccggcggagacgcgggcgagtggttagcaggaagaagatgagccttaagtctgaacgccgaggaattcatgtggatcaatcggatctcctgtgcaagaaaggatgtggttactacggcaaccctgcctggcagggtttctgctccaagtgctggagggaagagtaccacaaagccaggcagaagcagtccttccataaaccggcaaaccagcattgaaacggatagagtgtctaaggagttcatagaatttctcaagaccttccacaagacaggccaagaaatctataaacagaccaagctgtttttggaaggaatgcattacaaaagggatctaagcattgaagaacagtcagagtgtgctcaggatttctaccacaatgtggccgaaaggatgcaaactcgtgggaaagtgcctccagaaagagtcgagaagataatggatcagattgaaaagtacatcatgactcgtctctataaatatgtattctgtccagaaactactgatgatgagaagaaagatcttgccattcaaaagagaatcagagccctgcgctgggttacgcctcagatgctgtgtgtccctgttaatgaagacatcccagaagtgtctgatatggtggtgaaggcgatcacagatatcattgaaatggattccaagcgtgtgcctcgagacaagctggcctgcatcaccaagtgcagcaagcacatcttcaatgccatcaagatcaccaagaatgagccggcgtcagcggatgacttcctccccaccctcatctacattgttttgaagggcaaccccccacgccttcagtctaatatccagtatatcacgcgcttctgcaatccaagccgactgatgactggagaggatggctactatttcaccaatctgtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagagcattttttaaaggtacagtatatggggattgtttcgtttttcctagcaggggaaccttagttaataataaaatactacttatttgagttactgatacagattcatttaaggcttgtgtgcaaattttgtctcaatcttttttccctccatgattttcctatgtgcttcctctggcattcactgtggttttggtaaataattgccttttaaaggattaaacaaatgaatgctacaaagtgtatgttcaagaaaattaaatggtaccactcttccacagtttggaataattttataattgtaaagatagaaattatattgataagtaaatatgtaaaattgtaaatatgtaaaaaaaagaatggtgtctgctgtgcatggcattttatatgttaattttttagtttaaaatgaagtatattgaatgtttgcctttagcaccattttatttggtttgtcccactaaaatgactcgagaagtgtttagacaaactccccttaagatgtgcactccatctttaagaacgtgttagccttaactttgaggttctatatagtcagagactatgacaccactaaggttcagaataaagtttaggccacataaaattgctgtttaatgtagtcgatggaagactttaaactatgcttctagcttatttttccctcattcattcagcaaatctctattgagttcttcagtgagaaggagcaggcactgggcctggaatggaaggcgggaatgaatgggcctctgatggtgagaggtgacggggtccctcagctgtgagatgcaaggggcgccttgcagcctccataatatacatttgactttgcaaacgtctagacatgttttctgaacctttttcaggacatttcaacctcgggactattcatattagtggcctgagaggtgtttgttgtggggccaccctgtgcatggtagaatgttcagcagcattcctgccatccatatccattaggtgccagtagcacccccgctagagctgtgaaaaattctctccagacatagtcagatgtctcctggggccatatcacccctccgttaagaaccactgatgtcttttacaaaccaggagttatcctcctggtggttaatatggtgtaaccaaagaatcttgcactcaatgcacagtgtgatgttaactaaaacgagttaaatatttaggaggcttgacagctacctgcattgtagaaccttttcttatctcagtggaaccttctataacctaaatataccattgatgattcttcttccattcagtgacatccacagattatgcagctatacttgtgaaatcgtgcatgaggccccagggcaccgttctagaacaacgtcacttcacacaggcagctgagaaaggttctcttgcttttccagtatcttcctaaggatggagcccaaaattgcagagcagtaactttggaataaaaccagggtgggtataaaacttcttattcttaaatttacatataagatctattaagcttgacacatctgtgtcatcacgcactgaagacaggaagcagttcactgagtcagctggttcccaagctcgcacagaaggtgataagttactatcaaatgccagtgagaatcttcttatagaataacctgggcccaagtgattttagtacaaaacttgcccttctttggtttaattttctatgtgcttttaggtgtgaatccagatatgcggtcttaattcctttggaaatacacagttcgtttagttactgtacactctgtttgttcaataaactgcatatcaacttcccacaaaagctgacttttttgggtctcttacatataaagtaggttattgagttgatttttttggaggtatctcatattggtcgaattcttctggtatggactcttgccttatatagaggcttctatttctcttaagtcagcatcaatacaacggccggagtttctgtttttgcaataagaagatgttggtattttatgtagggtaaatgtgactggaatacacctttggaacggaattctttatcaataaagtttcacaatccgtccctcttcca

SEQ ID NO: 436881 - DNA, 3916 bp, Homo sapiens
ggctagcaggagggtgtgtgtggggcgggagcggacaacggagaccagacctactgcagccacgcgggcgagcggctgtgtggatgtcggcgaagccgcgggcgagggccttgggaactccaagacagaatggcccgaggcctggacactctctgaggacatctctgcaaaggccccagcggcccagatcactttgggaagcagtgacatccaacctgtatcaagtcttctaatctgtgaacatgtggttagcaggaagaagatgagccttaagtctgaacgccgaggaattcatgtggatcaatcggatctcctgtgcaagaaaggatgtggttactacggcaaccctgcctggcagggtttctgctccaagtgctggagggaagagtaccacaaagccaggcagaagcagattcaggaggactgggagctggcggagcgactccagcgggaggaagaagaggcctttgccagcagtcagagcagccaaggggcccaatccctcacattctccaagtttgaagaaaagaaaaccaacgagaagacccgcaaggttaccacagtgaagaaattcttcagtgcatcttccagggtcggatcaaagaaggaaattcaggaagcaaaagctcccagtccttccataaaccggcaaaccagcattgaaacggatagagtgtctaaggagttcatagaatttctcaagaccttccacaagacaggccaagaaatctataaacagaccaagctgtttttggaaggaatgcattacaaaagggatctaagcattgaagaacagtcagagtgtgctcaggatttctaccacaatgtggccgaaaggatgcaaactcgtgggaaagtgcctccagaaagagtcgagaagataatggatcagattgaaaagtacatcatgactcgtctctataaatatgtattctgtccagaaactactgatgatgagaagaaagatcttgccattcaaaagagaatcagagccctgcgctgggttacgcctcagatgctgtgtgtccctgttaatgaagacatcccagaagtgtctgatatggtggtgaaggcgatcacagatatcattgaaatggattccaagcgtgtgcctcgagacaagctggcctgcatcaccaagtgcagcaagcacatcttcaatgccatcaagatcaccaagaatgagccggcgtcagcggatgacttcctccccaccctcatctacattgttttgaagggcaaccccccacgccttcagtctaatatccagtatatcacgcgcttctgcaatccaagccgactgatgactggagaggatggctactatttcaccaatctgtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagagcattttttaaaggtacagtatatggggattgtttcgtttttcctagcaggggaaccttagttaataataaaatactacttatttgagttactgatacagattcatttaaggcttgtgtgcaaattttgtctcaatcttttttccctccatgattttcctatgtgcttcctctggcattcactgtggttttggtaaataattgccttttaaaggattaaacaaatgaatgctacaaagtgtatgttcaagaaaattaaatggtaccactcttccacagtttggaataattttataattgtaaagatagaaattatattgataagtaaatatgtaaaattgtaaatatgtaaaaaaaagaatggtgtctgctgtgcatggcattttatatgttaattttttagtttaaaatgaagtatattgaatgtttgcctttagcaccattttatttggtttgtcccactaaaatgactcgagaagtgtttagacaaactccccttaagatgtgcactccatctttaagaacgtgttagccttaactttgaggttctatatagtcagagactatgacaccactaaggttcagaataaagtttaggccacataaaattgctgtttaatgtagtcgatggaagactttaaactatgcttctagcttatttttccctcattcattcagcaaatctctattgagttcttcagtgagaaggagcaggcactgggcctggaatggaaggcgggaatgaatgggcctctgatggtgagaggtgacggggtccctcagctgtgagatgcaaggggcgccttgcagcctccataatatacatttgactttgcaaacgtctagacatgttttctgaacctttttcaggacatttcaacctcgggactattcatattagtggcctgagaggtgtttgttgtggggccaccctgtgcatggtagaatgttcagcagcattcctgccatccatatccattaggtgccagtagcacccccgctagagctgtgaaaaattctctccagacatagtcagatgtctcctggggccatatcacccctccgttaagaaccactgatgtcttttacaaaccaggagttatcctcctggtggttaatatggtgtaaccaaagaatcttgcactcaatgcacagtgtgatgttaactaaaacgagttaaatatttaggaggcttgacagctacctgcattgtagaaccttttcttatctcagtggaaccttctataacctaaatataccattgatgattcttcttccattcagtgacatccacagattatgcagctatacttgtgaaatcgtgcatgaggccccagggcaccgttctagaacaacgtcacttcacacaggcagctgagaaaggttctcttgcttttccagtatcttcctaaggatggagcccaaaattgcagagcagtaactttggaataaaaccagggtgggtataaaacttcttattcttaaatttacatataagatctattaagcttgacacatctgtgtcatcacgcactgaagacaggaagcagttcactgagtcagctggttcccaagctcgcacagaaggtgataagttactatcaaatgccagtgagaatcttcttatagaataacctgggcccaagtgattttagtacaaaacttgcccttctttggtttaattttctatgtgcttttaggtgtgaatccagatatgcggtcttaattcctttggaaatacacagttcgtttagttactgtacactctgtttgttcaataaactgcatatcaacttcccacaaaagctgacttttttgggtctcttacatataaagtaggttattgagttgatttttttggaggtatctcatattggtcgaattcttctggtatggactcttgccttatatagaggcttctatttctcttaagtcagcatcaatacaacggccggagtttctgtttttgcaataagaagatgttggtattttatgtagggtaaatgtgactggaatacacctttggaacggaattctttatcaataaagtttcacaatccgtccctcttcca

SEQ ID NO: 436882 - DNA, 4109 bp, Homo sapiens
gcattcaggacgcagaggaattagtatttactgtttttaacattccttacatgggaatcacgtaaagaatcaggtaaacaggattcaatttgtgactcaaccattaatactttgtgacactggctaatttatttcacttctggatgtcggttatgttttttttgagacaggatctcgctctgctgtcacccggcctggagttcagtggagggatctctgcaccgtcaacttcctgggctatcaagcgatcctcccacctcagcctccctggtagttgggaccacaggtgcccgccatcatgtccggctgatttgtaaaatttcttttgtagagatggtgaccttgctctgtggcccaggctggtctcgaactcctggactcaagcgatcctcctgcctgggcctcctaaagattcagctgcttttggatcaaccgatcgccttaagaccttttaactcgaacacctgtcacatcctaggatccgcgaaggactgaaacagagtttctgaagcgtccctcggcgcagtagctccgctccacctcccattcgcgctaccaccgcggccgcagccccaggagtcgccgcggagccagcgtcgccctccagctgttgcgcgtcggaagccggaagcagggactgagcgacagactaggaaacgccggtttctccggggctccccagcgccccacctttaccccggaggccgccctcttccatttgctcttgggcgtcagggcggtaccccactccgctcgaccctttggatccgctcgcacttcctcccgtccagagtcaaaggccccggaagtgacgtttacgcgccgcgcgtaaacgtgcgttcgctggcggtgccgggggcggggcgagcaggagggtgggtgtgaggcgggagctggccgcggagcccagacctacccgggcgaagcgggcgagcggtggtttggacgccggcggagacgcgggcgaggatctaagcattgaagaacagtcagagtgtgctcaggatttctaccacaatgtggccgaaaggatgcaaactcgtgggaaagtgcctccagaaagagtcgagaagataatggatcagattgaaaagtacatcatgactcgtctctataaatatgtattctgtccagaaactactgatgatgagaagaaagatcttgccattcaaaagagaatcagagccctgcgctgggttacgcctcagatgctgtgtgtccctgttaatgaagacatcccagaagtgtctgatatggtggtgaaggcgatcacagatatcattgaaatggattccaagcgtgtgcctcgagacaagctggcctgcatcaccaagtgcagcaagcacatcttcaatgccatcaagatcaccaagaatgagccggcgtcagcggatgacttcctccccaccctcatctacattgttttgaagggcaaccccccacgccttcagtctaatatccagtatatcacgcgcttctgcaatccaagccgactgatgactggagaggatggctactatttcaccaatctgtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagagcattttttaaaggtacagtatatggggattgtttcgtttttcctagcaggggaaccttagttaataataaaatactacttatttgagttactgatacagattcatttaaggcttgtgtgcaaattttgtctcaatcttttttccctccatgattttcctatgtgcttcctctggcattcactgtggttttggtaaataattgccttttaaaggattaaacaaatgaatgctacaaagtgtatgttcaagaaaattaaatggtaccactcttccacagtttggaataattttataattgtaaagatagaaattatattgataagtaaatatgtaaaattgtaaatatgtaaaaaaaagaatggtgtctgctgtgcatggcattttatatgttaattttttagtttaaaatgaagtatattgaatgtttgcctttagcaccattttatttggtttgtcccactaaaatgactcgagaagtgtttagacaaactccccttaagatgtgcactccatctttaagaacgtgttagccttaactttgaggttctatatagtcagagactatgacaccactaaggttcagaataaagtttaggccacataaaattgctgtttaatgtagtcgatggaagactttaaactatgcttctagcttatttttccctcattcattcagcaaatctctattgagttcttcagtgagaaggagcaggcactgggcctggaatggaaggcgggaatgaatgggcctctgatggtgagaggtgacggggtccctcagctgtgagatgcaaggggcgccttgcagcctccataatatacatttgactttgcaaacgtctagacatgttttctgaacctttttcaggacatttcaacctcgggactattcatattagtggcctgagaggtgtttgttgtggggccaccctgtgcatggtagaatgttcagcagcattcctgccatccatatccattaggtgccagtagcacccccgctagagctgtgaaaaattctctccagacatagtcagatgtctcctggggccatatcacccctccgttaagaaccactgatgtcttttacaaaccaggagttatcctcctggtggttaatatggtgtaaccaaagaatcttgcactcaatgcacagtgtgatgttaactaaaacgagttaaatatttaggaggcttgacagctacctgcattgtagaaccttttcttatctcagtggaaccttctataacctaaatataccattgatgattcttcttccattcagtgacatccacagattatgcagctatacttgtgaaatcgtgcatgaggccccagggcaccgttctagaacaacgtcacttcacacaggcagctgagaaaggttctcttgcttttccagtatcttcctaaggatggagcccaaaattgcagagcagtaactttggaataaaaccagggtgggtataaaacttcttattcttaaatttacatataagatctattaagcttgacacatctgtgtcatcacgcactgaagacaggaagcagttcactgagtcagctggttcccaagctcgcacagaaggtgataagttactatcaaatgccagtgagaatcttcttatagaataacctgggcccaagtgattttagtacaaaacttgcccttctttggtttaattttctatgtgcttttaggtgtgaatccagatatgcggtcttaattcctttggaaatacacagttcgtttagttactgtacactctgtttgttcaataaactgcatatcaacttcccacaaaagctgacttttttgggtctcttacatataaagtaggttattgagttgatttttttggaggtatctcatattggtcgaattcttctggtatggactcttgccttatatagaggcttctatttctcttaagtcagcatcaatacaacggccggagtttctgtttttgcaataagaagatgttggtattttatgtagggtaaatgtgactggaatacacctttggaacggaattctttatcaataaagtttcacaatccgtccctcttcca

SEQ ID NO: 436883 - DNA, 1811 bp, Homo sapiens
gcattcaggacgcagaggaattagtatttactgtttttaacattccttacatgggaatcacgtaaagaatcaggtaaacaggattcaatttgtgactcaaccattaatactttgtgacactggctaatttatttcacttctggatgtcggttatgttttttttgagacaggatctcgctctgctgtcacccggcctggagttcagtggagggatctctgcaccgtcaacttcctgggctatcaagcgatcctcccacctcagcctccctggtagttgggaccacaggtgcccgccatcatgtccggctgatttgtaaaatttcttttgtagagatggtgaccttgctctgtggcccaggctggtctcgaactcctggactcaagcgatcctcctgcctgggcctcctaaagattcagctgcttttggatcaaccgatcgccttaagaccttttaactcgaacacctgtcacatcctaggatccgcgaaggactgaaacagagtttctgaagcgtccctcggcgcagtagctccgctccacctcccattcgcgctaccaccgcggccgcagccccaggagtcgccgcggagccagcgtcgccctccagctgttgcgcgtcggaagccggaagcagggactgagcgacagactaggaaacgccggtttctccggggctccccagcgccccacctttaccccggaggccgccctcttccatttgctcttgggcgtcagggcggtaccccactccgctcgaccctttggatccgctcgcacttcctcccgtccagagtcaaaggccccggaagtgacgtttacgcgccgcgcgtaaacgtgcgttcgctggcggtgccgggggcggggcgagcaggagggtgggtgtgaggcgggagctggccgcggagcccagacctacccgggcgaagcgggcgagcggtggtttggacgccggcggagacgcgggcgaggtacggagcggacggactggggctgagagctgctcggctctcagctacaggagcggggcggcggggcgtctcgggctgggggtggcagggcggtcggtccgtgccatccgcgcggctggggcagttgcgcgtcggtgcctcccgctgtccttcgtcccacattccgtctccgtcagcgccgccttccccgttccaggccgccctcggctcccttaatcctcagagtgcggcctctccgtcccagacgctagttgccgggatctccagcgccagccgagccccgacggcctgacgcggagcatttcctggccgcctccctctccggcggctcccctcgccccggctcccaccttccgtccaggccgctggctccgaagcagcgtctgtggtcgcacggggcccctcccacaacctccccggaaagcgctggtatgggacgctcggacccagaccacagcccccggccgcggcaggggcgcggggacttgatcccacgtcaccctagggggcagaagtgtcccggagttgggaggggatttgaagcctgtggtcctgacttccaccccgtggctgagggcgaggctgcggggccggggttaggagcagaagtccctgcttccgaaccgtctgggaggagagccgagggatgcccatcacggcagtttagggagagagagggagggactctgccgctttggaggctaggtcataggcagctggcggtgtctcagcgcgggtgaccaatccttgcggttgggaaatgtgtcgtgggcgcccgtgggctcgttttgcctttgagattaggtaggaaattttcccaggacgagtttaccggagcacctt

SEQ ID NO: 436884 - DNA, 846 bp, Homo sapiens
  misc_feature (762)..(762): n is a, c, g, or t
gcattcaggacgcagaggaattagtatttactgtttttaacattccttacatgggaatcacgtaaagaatcaggtaaacaggattcaatttgtgactcaaccattaatactttgtgacactggctaatttatttcacttctggatgtcggttatgttttttttgagacaggatctcgctctgctgtcacccggcctggagttcagtggagggatctctgcaccgtcaacttcctgggctatcaagcgatcctcccacctcagcctccctggtagttgggaccacaggtgcccgccatcatgtccggctgatttgtaaaatttcttttgtagagatggtgaccttgctctgtggcccaggctggtctcgaactcctggactcaagcgatcctcctgcctgggcctcctaaagattcagctgcttttggatcaaccgatcgccttaagaccttttaactcgaacacctgtcacatcctaggatccgcgaaggactgaaacagagtttctgaagcgtccctcggcgcagtagctccgctccacctcccattcgcgctaccaccgcggccgcagccccaggagtcgccgcggagccagcgtcgccctccagctgttgcgcgtcggaagccggaagcagggactgagcgacagactaggaaacgccggtttctccggggctccccagcgccccacctttaccccggaggccgccctcttccatttgctcttgggcgtcagggtgggtggggttgggaagggaccggngtgcgggagcggctgccgggagtgcctggggagccggggctgctgtagccgtggcgatcccctgatttggggaggttcaccaga

SEQ ID NO: 436885 - DNA, 1213 bp, Homo sapiens
agggggtgtgtgtgaggctggagcggactggggagcccagacctgccgagcgacgtgggcgagcggtgacctggaccacggcgcagacgcgggcgagctgcggctcggacgccagcggacacgcgggcgagatcactttgggaagcagtgacatccaacctgtatcaagtcttctaatctgtgaacatggctggagtgcagtgtcgtgatcacagcccactgcagcctcgacctcccgggctgaagggatcctcgcacctcagcctcctgagtagctgagactataggctggagtaccatgacaggatcctagctcactgcatcctcaaactcatgggctcaagtgattctcctgctttagtctcccgagtagctgggactacagagatgggtctcggctgtgttacctaagctggagtgcagtggctattcccagcacaatcatagtgcactacagtctccaactcctgggttcaggtgctccttgtgcctccgcctcctgaatagctgggattgcaggcatgtgccatcatgcctggctatgtgccttcaaaaagactacagttgtggatggagtgttttatcaatattagttggtttatgattgtgtttagttccatatcctagctgattttctatctgttctgtccattcttgaagagtccaactataattttgagtttgtctatttctcctcaagttctatatttgaggtctgtttttagatgtgtacacattttaaatggtgttgggtctttaccattatgtaatgtccctcttaatctattgtaaatttccttgctttgaggtatagtttgtcttatgtaaatataatcagttcagttttcctttgaccagcatttacgtaacatatctttttccatttttaaacttataatctacctatattaaaatatatagtcaggccaggtgctgggattacaggcgtgagccactgcatgtggctgctctctgttttttatgcctcactgtttcctttcctgccttcttttgggttatttgactattgcttagtattcaattttaatttatcaattgattattttattatatctctttgtgtagtgttctttagtggtggctctaagaattacagtatgtacaccaaactttttactttctgcttagaattaatattttaccacttgtaaaatgtaggaacctggctatcatgtaggttcctttcccctgt

SEQ ID NO: 436886 - DNA, 511 bp, Homo sapiens
ggctagcaggagggtgtgtgtggggcgggagcggacaacggagaccagacctactgcagccacgcgggcgagcggctgtgtggatgtcggcgaagccgcgggcgagggccttgggaactccaagacagaatggcccgaggcctggacactctctgaggacatctctgcaaaggccccagcggcccagatcactttgggaagcagtgacatccaacctgtatcaagtcttctaatctgtgaacatgagatgggtctcggctgtgttacctaagctggagtgcagtggctattcccagcacaatcatagtgcactacagtctccaactcctgggttcaggtgctccttgtgcctccgcctcctgaatagctgggattcaccatgctcagctaatttttgtatgtttaatagagacgaggttttgccatgttggccaggctggtctcaaactcctgccctcaggtgatccacccgcctcagcctcccaaagtgctgggattataggtgtgagcc

SEQ ID NO: 436887 - DNA, 513 bp, Homo sapiens
gtgacactctgtctcaaaaacaaccaaaaaaaggatcctatttatcctttaagacctcacccaaacatcaccgttgtaaagcctcgtcagactcccccagcagattgagttgttctttcctgtgttctcacagcactcaacttttactctctgatgtagcagctgtcccattctgtagcagttgtttacttacctttttgtctgttccagccttgagcttgttagggaaaaggattagacttgatttctttcatgtaaccctagagcagtagctgaatgagtatgagaagaccccatttgaaatctgtagtgcatgaagagccgtccatcctgtagcaatgtgagacctcagactgatttggcatatttagtctctaggtctaaaatctttagatcctcctgaattaatggagtaataaccttcacatacagagaaaccttggagaatatctaggtcattctaatcctctcttgaattgcagactccagcgggaggaagaagaggcctttgcc

SEQ ID NO: 436888 - DNA, 183 bp, Homo sapiens
gatgagaagaaagatcttgccattcaaaagagaatcaggtagttgcttattttgttttgctttgtagttactaccttctaatggaagaacacactggggggaaaataatgcacctgtgtttcaaaccttaagggaaagcaatagctcatgttcctgcttccttagagtggaagcagctctgtt

SEQ ID NO: 436889 - DNA, 283 bp, Homo sapiens
gtttgttttgtttactttagcttctgttttaaatggtctgtgatcaaaagatttttacaaatcgactcgagtatgcatagctttcctaatatgactgtattaacgtcctcttcttgtagtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaactt

SEQ ID NO: 436890 - DNA, 723 bp, Homo sapiens
agggggtgtgtgtgaggctggagcggactggggagcccagacctgccgagcgacgtgggcgagcggtgacctggaccacggcgcagacgcgggcgagctgcggctcggacgccagcggacacgcgggcgagatgtttgaagtgaggccaggcatgttggctcacgcctgtaatcccagcactttcggaggccaaggtgggagaatcacttgaggctaggagttggagaccagcctgggcaacatagcaagactgcatctctacaaaaaaaaagaaaagattcttgaagtgaatgtatactcatttcctggttgtttctttctgtaaggatgtctgacccagctaatttgtaaacaggaattctgcactcatttctgtttttgcattctcaaccccagttgggcacacaagtgtttaatgagtatttaactgatttgataagaataaattcattgatttctttgatttttgttgctggttttcagtgaacaaaatgttaccagtacttactcattgtgatgtctacatatacaactaagattctgtttacctatgtcagtctctggctagagacatagaatttcagtcttgactgtgtgagtttaatttctggcacgtggggttttattggctgcagagcaaacatctctagcagagatgacctatccctcaaatgtaggaaatacctgtgtaaacctaacacctgtgactcagaatagaaatg

SEQ ID NO: 436891 - DNA, 4859 bp, Homo sapiens
gcattcaggacgcagaggaattagtatttactgtttttaacattccttacatgggaatcacgtaaagaatcaggtaaacaggattcaatttgtgactcaaccattaatactttgtgacactggctaatttatttcacttctggatgtcggttatgttttttttgagacaggatctcgctctgctgtcacccggcctggagttcagtggagggatctctgcaccgtcaacttcctgggctatcaagcgatcctcccacctcagcctccctggtagttgggaccacaggtgcccgccatcatgtccggctgatttgtaaaatttcttttgtagagatggtgaccttgctctgtggcccaggctggtctcgaactcctggactcaagcgatcctcctgcctgggcctcctaaagattcagctgcttttggatcaaccgatcgccttaagaccttttaactcgaacacctgtcacatcctaggatccgcgaaggactgaaacagagtttctgaagcgtccctcggcgcagtagctccgctccacctcccattcgcgctaccaccgcggccgcagccccaggagtcgccgcggagccagcgtcgccctccagctgttgcgcgtcggaagccggaagcagggactgagcgacagactaggaaacgccggtttctccggggctccccagcgccccacctttaccccggaggccgccctcttccatttgctcttgggcgtcagggcggtaccccactccgctcgaccctttggatccgctcgcacttcctcccgtccagagtcaaaggccccggaagtgacgtttacgcgccgcgcgtaaacgtgcgttcgctggcggtgccgggggcggggcgagcaggagggtgggtgtgaggcgggagctggccgcggagcccagacctacccgggcgaagcgggcgagcggtggtttggacgccggcggagacgcgggcgagtggttagcaggaagaagatgagccttaagtctgaacgccgaggaattcatgtggatcaatcggatctcctgtgcaagaaaggatgtggttactacggcaaccctgcctggcagggtttctgctccaagtgctggagggaagagtaccacaaagccaggcagaagcagattcaggaggactgggagctggcggagcgactccagcgggaggaagaagaggcctttgccagcagtcagagcagccaaggggcccaatccctcacattctccaagtttgaagaaaagaaaaccaacgagaagacccgcaaggttaccacagtgaagaaattcttcagtgcatcttccagggtcggatcaaagaaggaaattcaggaagcaaaagctcccagtccttccataaaccggcaaaccagcattgaaacggatagagtgtctaaggagttcatagaatttctcaagaccttccacaagacaggccaagaaatctataaacagaccaagctgtttttggaaggaatgcattacaaaagggatctaagcattgaagaacagtcagagtgtgctcaggatttctaccacaatgtggccgaaaggatgcaaactcgtgggaaagtgcctccagaaagagtcgagaagataatggatcagattgaaaagtacatcatgactcgtctctataaatatgtattctgtccagaaactactgatgatgagaagaaagatcttgccattcaaaagagaatcagagccctgcgctgggttacgcctcagatgctgtgtgtccctgttaatgaagacatcccagaagtgtctgatatggtggtgaaggcgatcacagatatcattgaaatggattccaagcgtgtgcctcgagacaagctggcctgcatcaccaagtgcagcaagcacatcttcaatgccatcaagatcaccaagaatgagccggcgtcagcggatgacttcctccccaccctcatctacattgttttgaagggcaaccccccacgccttcagtctaatatccagtatatcacgcgcttctgcaatccaagccgactgatgactggagaggatggctactatttcaccaatctgtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagagcattttttaaaggtacagtatatggggattgtttcgtttttcctagcaggggaaccttagttaataataaaatactacttatttgagttactgatacagattcatttaaggcttgtgtgcaaattttgtctcaatcttttttccctccatgattttcctatgtgcttcctctggcattcactgtggttttggtaaataattgccttttaaaggattaaacaaatgaatgctacaaagtgtatgttcaagaaaattaaatggtaccactcttccacagtttggaataattttataattgtaaagatagaaattatattgataagtaaatatgtaaaattgtaaatatgtaaaaaaaagaatggtgtctgctgtgcatggcattttatatgttaattttttagtttaaaatgaagtatattgaatgtttgcctttagcaccattttatttggtttgtcccactaaaatgactcgagaagtgtttagacaaactccccttaagatgtgcactccatctttaagaacgtgttagccttaactttgaggttctatatagtcagagactatgacaccactaaggttcagaataaagtttaggccacataaaattgctgtttaatgtagtcgatggaagactttaaactatgcttctagcttatttttccctcattcattcagcaaatctctattgagttcttcagtgagaaggagcaggcactgggcctggaatggaaggcgggaatgaatgggcctctgatggtgagaggtgacggggtccctcagctgtgagatgcaaggggcgccttgcagcctccataatatacatttgactttgcaaacgtctagacatgttttctgaacctttttcaggacatttcaacctcgggactattcatattagtggcctgagaggtgtttgttgtggggccaccctgtgcatggtagaatgttcagcagcattcctgccatccatatccattaggtgccagtagcacccccgctagagctgtgaaaaattctctccagacatagtcagatgtctcctggggccatatcacccctccgttaagaaccactgatgtcttttacaaaccaggagttatcctcctggtggttaatatggtgtaaccaaagaatcttgcactcaatgcacagtgtgatgttaactaaaacgagttaaatatttaggaggcttgacagctacctgcattgtagaaccttttcttatctcagtggaaccttctataacctaaatataccattgatgattcttcttccattcagtgacatccacagattatgcagctatacttgtgaaatcgtgcatgaggccccagggcaccgttctagaacaacgtcacttcacacaggcagctgagaaaggttctcttgcttttccagtatcttcctaaggatggagcccaaaattgcagagcagtaactttggaataaaaccagggtgggtataaaacttcttattcttaaatttacatataagatctattaagcttgacacatctgtgtcatcacgcactgaagacaggaagcagttcactgagtcagctggttcccaagctcgcacagaaggtgataagttactatcaaatgccagtgagaatcttcttatagaataacctgggcccaagtgattttagtacaaaacttgcccttctttggtttaattttctatgtgcttttaggtgtgaatccagatatgcggtcttaattcctttggaaatacacagttcgtttagttactgtacactctgtttgttcaataaactgcatatcaacttcccacaaaagctgacttttttgggtctcttacatataaagtaggttattgagttgatttttttggaggtatctcatattggtcgaattcttctggtatggactcttgccttatatagaggcttctatttctcttaagtcagcatcaatacaacggccggagtttctgtttttgcaataagaagatgttggtattttatgtagggtaaatgtgactggaatacacctttggaacggaattctttatcaataaagtttcacaatccgtccctcttccaaaaattgatttggttctttcttaggaaaatatacattattattaatattctcatgctacagaggttttctggttaagctatacctaaaaatgaaacattagagacatttgtcagttaaaattaagaagacaagaatatttgctgtcaccacaatcaatcaaccttgttcttgcagttctaccaaggtactcagtcttcaaacagacataaaagtagagaa

SEQ ID NO: 436892 - DNA, 5068 bp, Homo sapiens
gcattcaggacgcagaggaattagtatttactgtttttaacattccttacatgggaatcacgtaaagaatcaggtaaacaggattcaatttgtgactcaaccattaatactttgtgacactggctaatttatttcacttctggatgtcggttatgttttttttgagacaggatctcgctctgctgtcacccggcctggagttcagtggagggatctctgcaccgtcaacttcctgggctatcaagcgatcctcccacctcagcctccctggtagttgggaccacaggtgcccgccatcatgtccggctgatttgtaaaatttcttttgtagagatggtgaccttgctctgtggcccaggctggtctcgaactcctggactcaagcgatcctcctgcctgggcctcctaaagattcagctgcttttggatcaaccgatcgccttaagaccttttaactcgaacacctgtcacatcctaggatccgcgaaggactgaaacagagtttctgaagcgtccctcggcgcagtagctccgctccacctcccattcgcgctaccaccgcggccgcagccccaggagtcgccgcggagccagcgtcgccctccagctgttgcgcgtcggaagccggaagcagggactgagcgacagactaggaaacgccggtttctccggggctccccagcgccccacctttaccccggaggccgccctcttccatttgctcttgggcgtcagggcggtaccccactccgctcgaccctttggatccgctcgcacttcctcccgtccagagtcaaaggccccggaagtgacgtttacgcgccgcgcgtaaacgtgcgttcgctggcggtgccgggggcggggcgagcaggagggtgggtgtgaggcgggagctggccgcggagcccagacctacccgggcgaagcgggcgagcggtggtttggacgccggcggagacgcgggcgaggtacggagcggacggactggggctgagagctgctcggctctcagctacaggagcggggcggcggggcgtctcgggctgggggtggcagggcggtcggtccgtgccatccgcgcggctggggcagttgcgcgtcggtgcctcccgctgtccttcgtcccacattccgtctccgtcagcgccgccttccccgttccaggccgccctcggctcccttaatcctcagagtgcggcctctccgtcccagacgctagttgccgggatctccagcgccagccgagccccgacggcctgacgcggagcatttcctggccgcctccctctccggcggctcccctcgccccggctcccaccttccgtccaggccgctggctccgaagcagcgtctgtggtcgcacggggcccctcccacaacctccccggaaagcgctgtggttagcaggaagaagatgagccttaagtctgaacgccgaggaattcatgtggatcaatcggatctcctgtgcaagaaaggatgtggttactacggcaaccctgcctggcagggtttctgctccaagtgctggagggaagagtaccacaaagccaggcagaagcagattcaggaggactgggagctggcggagcgactccagcgggaggaagaagaggcctttgccagcagtcagagcagccaaggggcccaatccctcacattctccaagtttgaagaaaagaaaaccaacgagaagacccgcaaggttaccacagtgaagaaattcttcagtgcatcttccagggtcggatcaaagaaggaaattcaggaagcaaaagctcccagtccttccataaaccggcaaaccagcattgaaacggatagagtgtctaaggagttcatagaatttctcaagaccttccacaagacaggccaagaaatctataaacagaccaagctgtttttggaaggaatgcattacaaaagggatctaagcattgaagaacagtcagagtgtgctcaggatttctaccacaatgtggccgaaaggatgcaaactcgtgggaaagtgcctccagaaagagtcgagaagataatggatcagattgaaaagtacatcatgactcgtctctataaatatgtattctgtccagaaactactgatgatgagaagaaagatcttgccattcaaaagagaatcagagccctgcgctgggttacgcctcagatgctgtgtgtccctgttaatgaagacatcccagaagtgtctgatatggtggtgaaggcgatcacagatatcattgaaatggattccaagcgtgtgcctcgagacaagctggcctgcatcaccaagtgcagcaagcacatcttcaatgccatcaagatcaccaagaatgagccggcgtcagcggatgacttcctccccaccctcatctacattgttttgaagggcaaccccccacgccttcagtctaatatccagtatatcacgcgcttctgcaatccaagccgactgatgactggagaggatggctactatttcaccaatctgtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagagcattttttaaaggtacagtatatggggattgtttcgtttttcctagcaggggaaccttagttaataataaaatactacttatttgagttactgatacagattcatttaaggcttgtgtgcaaattttgtctcaatcttttttccctccatgattttcctatgtgcttcctctggcattcactgtggttttggtaaataattgccttttaaaggattaaacaaatgaatgctacaaagtgtatgttcaagaaaattaaatggtaccactcttccacagtttggaataattttataattgtaaagatagaaattatattgataagtaaatatgtaaaattgtaaatatgtaaaaaaaagaatggtgtctgctgtgcatggcattttatatgttaattttttagtttaaaatgaagtatattgaatgtttgcctttagcaccattttatttggtttgtcccactaaaatgactcgagaagtgtttagacaaactccccttaagatgtgcactccatctttaagaacgtgttagccttaactttgaggttctatatagtcagagactatgacaccactaaggttcagaataaagtttaggccacataaaattgctgtttaatgtagtcgatggaagactttaaactatgcttctagcttatttttccctcattcattcagcaaatctctattgagttcttcagtgagaaggagcaggcactgggcctggaatggaaggcgggaatgaatgggcctctgatggtgagaggtgacggggtccctcagctgtgagatgcaaggggcgccttgcagcctccataatatacatttgactttgcaaacgtctagacatgttttctgaacctttttcaggacatttcaacctcgggactattcatattagtggcctgagaggtgtttgttgtggggccaccctgtgcatggtagaatgttcagcagcattcctgccatccatatccattaggtgccagtagcacccccgctagagctgtgaaaaattctctccagacatagtcagatgtctcctggggccatatcacccctccgttaagaaccactgatgtcttttacaaaccaggagttatcctcctggtggttaatatggtgtaaccaaagaatcttgcactcaatgcacagtgtgatgttaactaaaacgagttaaatatttaggaggcttgacagctacctgcattgtagaaccttttcttatctcagtggaaccttctataacctaaatataccattgatgattcttcttccattcagtgacatccacagattatgcagctatacttgtgaaatcgtgcatgaggccccagggcaccgttctagaacaacgtcacttcacacaggcagctgagaaaggttctcttgcttttccagtatcttcctaaggatggagcccaaaattgcagagcagtaactttggaataaaaccagggtgggtataaaacttcttattcttaaatttacatataagatctattaagcttgacacatctgtgtcatcacgcactgaagacaggaagcagttcactgagtcagctggttcccaagctcgcacagaaggtgataagttactatcaaatgccagtgagaatcttcttatagaataacctgggcccaagtgattttagtacaaaacttgcccttctttggtttaattttctatgtgcttttaggtgtgaatccagatatgcggtcttaattcctttggaaatacacagttcgtttagttactgtacactctgtttgttcaataaactgcatatcaacttcccacaaaagctgacttttttgggtctcttacatataaagtaggttattgagttgatttttttggaggtatctcatattggtcgaattcttctggtatggactcttgccttatatagaggcttctatttctcttaagtcagcatcaatacaacggccggagtttctgtttttgcaataagaagatgttggtattttatgtagggtaaatgtgactggaatacacctttggaacggaattctttatcaataaagtttcacaatccgtccctcttcca

SEQ ID NO: 436893 - DNA, 4369 bp, Homo sapiens
gcattcaggacgcagaggaattagtatttactgtttttaacattccttacatgggaatcacgtaaagaatcaggtaaacaggattcaatttgtgactcaaccattaatactttgtgacactggctaatttatttcacttctggatgtcggttatgttttttttgagacaggatctcgctctgctgtcacccggcctggagttcagtggagggatctctgcaccgtcaacttcctgggctatcaagcgatcctcccacctcagcctccctggtagttgggaccacaggtgcccgccatcatgtccggctgatttgtaaaatttcttttgtagagatggtgaccttgctctgtggcccaggctggtctcgaactcctggactcaagcgatcctcctgcctgggcctcctaaagattcagctgcttttggatcaaccgatcgccttaagaccttttaactcgaacacctgtcacatcctaggatccgcgaaggactgaaacagagtttctgaagcgtccctcggcgcagtagctccgctccacctcccattcgcgctaccaccgcggccgcagccccaggagtcgccgcggagccagcgtcgccctccagctgttgcgcgtcggaagccggaagcagggactgagcgacagactaggaaacgccggtttctccggggctccccagcgccccacctttaccccggaggccgccctcttccatttgctcttgggcgtcagggcggtaccccactccgctcgaccctttggatccgctcgcacttcctcccgtccagagtcaaaggccccggaagtgacgtttacgcgccgcgcgtaaacgtgcgttcgctggcggtgccgggggcggggcgagcaggagggtgggtgtgaggcgggagctggccgcggagcccagacctacccgggcgaagcgggcgagcggtggtttggacgccggcggagacgcgggcgagtggttagcaggaagaagatgagccttaagtctgaacgccgaggaattcatgtggatcaatcggatctcctgtgcaagaaaggatgtggttactacggcaaccctgcctggcagggtttctgctccaagtgctggagggaagagtaccacaaagccaggcagaagcagattcaggaggactgggagctggcggagcgactccagcgggaggaagaagaggcctttgccagcagtcagagcagccaaggggcccaatccctcacattctccaagtttgaagaaaagaaaaccaacgagaagacccgcaaggttaccacagtgaagaaattcttcagtgcatcttccagggtcggatcaaagaaggaaattcaggaagcaaaagctcccagtccttccataaaccggcaaaccagcattgaaacggatagagtgtctaaggagttcatagaatttctcaagaccttccacaagacaggccaagaaatctataaacagaccaagctgtttttggaaggaatgcattacaaaagggatctaagcattgaagaacagtcagagtgtgctcaggatttctaccacaatgtggccgaaaggatgcaaactcgtgggaaagtgcctccagaaagagtcgagaagataatggatcagattgaaaagtacatcatgactcgtctctataaatatgtattctgtccagaaactactgatgatgagaagaaagatcttgccattcaaaagagaatcagagccctgcgctgggttacgcctcagatgctgtgtgtccctgttaatgaagacatcccagaagtgtctgatatggtggtgaaggcgatcacagatatcattgaaatggattccaagcgtgtgcctcgagacaagctggcctgcatcaccaagtgcagcaagcacatcttcaatgccatcaagatcaccaagaatgagccggcgtcagcggatgacttcctccccaccctcatctacattgttttgaagggcaaccccccacgccttcagtctaatatccagtatatcacgcgcttctgcaatccaagccgactgatgactggagaggatggctactatttcaccaatctgtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagagcattttttaaaggtacagtatatggggattgtttcgtttttcctagcaggggaaccttagttaataataaaatactacttatttgagttactgatacagattcatttaaggcttgtgtgcaaattttgtctcaatcttttttccctccatgattttcctatgtgcttcctctggcattcactgtggttttggtaaataattgccttttaaaggattaaacaaatgaatgctacaaagtgtatgttcaagaaaattaaatggtaccactcttccacagtttggaataattttataattgtaaagatagaaattatattgataagtaaatatgtaaaattgtaaatatgtaaaaaaaagaatggtgtctgctgtgcatggcattttatatgttaattttttagtttaaaatgaagtatattgaatgtttgcctttagcaccattttatttggtttgtcccactaaaatgactcgagaagtgtttagacaaactccccttaagatgtgcactccatctttaagaacgtgttagccttaactttgaggttctatatagtcagagactatgacaccactaaggttcagaataaagtttaggccacataaaattgctgtttaatgtagtcgatggaagactttaaactatgcttctagcttatttttccctcattcattcagcaaatctctattgagttcttcagtgagaaggagcaggcactgggcctggaatggaaggcgggaatgaatgggcctctgatggtgagaggtgacggggtccctcagctgtgagatgcaaggggcgccttgcagcctccataatatacatttgactttgcaaacgtctagacatgttttctgaacctttttcaggacatttcaacctcgggactattcatattagtggcctgagaggtgtttgttgtggggccaccctgtgcatggtagaatgttcagcagcattcctgccatccatatccattaggtgccagtagcacccccgctagagctgtgaaaaattctctccagacatagtcagatgtctcctggggccatatcacccctccgttaagaaccactgatgtcttttacaaaccaggagttatcctcctggtggttaatatggtgtaaccaaagaatcttgcactcaatgcacagtgtgatgttaactaaaacgagttaaatatttaggaggcttgacagctacctgcattgtagaaccttttcttatctcagtggaaccttctataacctaaatataccattgatgattcttcttccattcagtgacatccacagattatgcagctatacttgtgaaatcgtgcatgaggccccagggcaccgttctagaacaacgtcacttcacacaggcagctgagaaaggttctcttgcttttccagtatcttcctaaggatggagcccaaaattgcagagcagtaactttggaataaaaccagggtgggtataaaacttcttattcttaaatttacatataagatctattaagcttgacacatctgtgtcatcacgcactgaagacaggaagcagttcactgagtcagctggttcccaagctcgcacagaaggtgataagttactatcaaatgccagtgagaatcttcttatagaataacctgggcccaagtgattttagtacaaaacttgcccttctttggtttaattttctatgtgcttttaggtgtgaatccagatatgcggtcttaattcctttggaaatacacagttcgtttagttactgtacactctgtttgttcaataaactgcatatcaacttcccaca

SEQ ID NO: 436894 - DNA, 4557 bp, Homo sapiens
gcattcaggacgcagaggaattagtatttactgtttttaacattccttacatgggaatcacgtaaagaatcaggtaaacaggattcaatttgtgactcaaccattaatactttgtgacactggctaatttatttcacttctggatgtcggttatgttttttttgagacaggatctcgctctgctgtcacccggcctggagttcagtggagggatctctgcaccgtcaacttcctgggctatcaagcgatcctcccacctcagcctccctggtagttgggaccacaggtgcccgccatcatgtccggctgatttgtaaaatttcttttgtagagatggtgaccttgctctgtggcccaggctggtctcgaactcctggactcaagcgatcctcctgcctgggcctcctaaagattcagctgcttttggatcaaccgatcgccttaagaccttttaactcgaacacctgtcacatcctaggatccgcgaaggactgaaacagagtttctgaagcgtccctcggcgcagtagctccgctccacctcccattcgcgctaccaccgcggccgcagccccaggagtcgccgcggagccagcgtcgccctccagctgttgcgcgtcggaagccggaagcagggactgagcgacagactaggaaacgccggtttctccggggctccccagcgccccacctttaccccggaggccgccctcttccatttgctcttgggcgtcagggcggtaccccactccgctcgaccctttggatccgctcgcacttcctcccgtccagagtcaaaggccccggaagtgacgtttacgcgccgcgcgtaaacgtgcgttcgctggcggtgccgggggcggggcgagcaggagggtgggtgtgaggcgggagctggccgcggagcccagacctacccgggcgaagcgggcgagcggtggtttggacgccggcggagacgcgggcgagtggttagcaggaagaagatgagccttaagtctgaacgccgaggaattcatgtggatcaatcggatctcctgtgcaagaaaggatgtggttactacggcaaccctgcctggcagggtttctgctccaagtgctggagggaagagtaccacaaagccaggcagaagcagattcaggaggactgggagctggcggagcgactccagcgggaggaagaagaggcctttgccagcagtcagagcagccaaggggcccaatccctcacattctccaagtttgaagaaaagaaaaccaacgagaagacccgcaaggttaccacagtgaagaaattcttcagtgcatcttccagggtcggatcaaagaaggaaattcaggaagcaaaagctcccagtccttccataaaccggcaaaccagcattgaaacggatagagtgtctaaggagttcatagaatttctcaagaccttccacaagacaggccaagaaatctataaacagaccaagctgtttttggaaggaatgcattacaaaaggtgcctccagaaagagtcgagaagataatggatcagattgaaaagtacatcatgactcgtctctataaatatgtattctgtccagaaactactgatgatgagaagaaagatcttgccattcaaaagagaatcagagccctgcgctgggttacgcctcagatgctgtgtgtccctgttaatgaagacatcccagaagtgtctgatatggtggtgaaggcgatcacagatatcattgaaatggattccaagcgtgtgcctcgagacaagctggcctgcatcaccaagtgcagcaagcacatcttcaatgccatcaagatcaccaagaatgagccggcgtcagcggatgacttcctccccaccctcatctacattgttttgaagggcaaccccccacgccttcagtctaatatccagtatatcacgcgcttctgcaatccaagccgactgatgactggagaggatggctactatttcaccaatctgtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagagcattttttaaaggtacagtatatggggattgtttcgtttttcctagcaggggaaccttagttaataataaaatactacttatttgagttactgatacagattcatttaaggcttgtgtgcaaattttgtctcaatcttttttccctccatgattttcctatgtgcttcctctggcattcactgtggttttggtaaataattgccttttaaaggattaaacaaatgaatgctacaaagtgtatgttcaagaaaattaaatggtaccactcttccacagtttggaataattttataattgtaaagatagaaattatattgataagtaaatatgtaaaattgtaaatatgtaaaaaaaagaatggtgtctgctgtgcatggcattttatatgttaattttttagtttaaaatgaagtatattgaatgtttgcctttagcaccattttatttggtttgtcccactaaaatgactcgagaagtgtttagacaaactccccttaagatgtgcactccatctttaagaacgtgttagccttaactttgaggttctatatagtcagagactatgacaccactaaggttcagaataaagtttaggccacataaaattgctgtttaatgtagtcgatggaagactttaaactatgcttctagcttatttttccctcattcattcagcaaatctctattgagttcttcagtgagaaggagcaggcactgggcctggaatggaaggcgggaatgaatgggcctctgatggtgagaggtgacggggtccctcagctgtgagatgcaaggggcgccttgcagcctccataatatacatttgactttgcaaacgtctagacatgttttctgaacctttttcaggacatttcaacctcgggactattcatattagtggcctgagaggtgtttgttgtggggccaccctgtgcatggtagaatgttcagcagcattcctgccatccatatccattaggtgccagtagcacccccgctagagctgtgaaaaattctctccagacatagtcagatgtctcctggggccatatcacccctccgttaagaaccactgatgtcttttacaaaccaggagttatcctcctggtggttaatatggtgtaaccaaagaatcttgcactcaatgcacagtgtgatgttaactaaaacgagttaaatatttaggaggcttgacagctacctgcattgtagaaccttttcttatctcagtggaaccttctataacctaaatataccattgatgattcttcttccattcagtgacatccacagattatgcagctatacttgtgaaatcgtgcatgaggccccagggcaccgttctagaacaacgtcacttcacacaggcagctgagaaaggttctcttgcttttccagtatcttcctaaggatggagcccaaaattgcagagcagtaactttggaataaaaccagggtgggtataaaacttcttattcttaaatttacatataagatctattaagcttgacacatctgtgtcatcacgcactgaagacaggaagcagttcactgagtcagctggttcccaagctcgcacagaaggtgataagttactatcaaatgccagtgagaatcttcttatagaataacctgggcccaagtgattttagtacaaaacttgcccttctttggtttaattttctatgtgcttttaggtgtgaatccagatatgcggtcttaattcctttggaaatacacagttcgtttagttactgtacactctgtttgttcaataaactgcatatcaacttcccacaaaagctgacttttttgggtctcttacatataaagtaggttattgagttgatttttttggaggtatctcatattggtcgaattcttctggtatggactcttgccttatatagaggcttctatttctcttaagtcagcatcaatacaacggccggagtttctgtttttgcaataagaagatgttggtattttatgtagggtaaatgtgactggaatacacctttggaacggaattctttatcaataaagtttcacaatccgtccctcttcca

SEQ ID NO: 436895 - DNA, 3359 bp, Homo sapiens
cacgcgtcggcacgcgtcgctgtgcatcttccagggtcggatcaaagaaggaaattcaggaagcaaaagctcccagtccttccataaaccggcaaaccagcattgaaacggatagagtgtctaaggagttcatagaatttctcaagaccttccacaagacaggccaagaaatctataaacagaccaagctgtttttggaaggaatgcattacaaaagggatctaagcattgaagaacagtcagagtgtgctcaggatttctaccacaatgtggccgaaaggatgcaaactcgtgggaaagtgcctccagaaagagtcgagaagataatggatcagattgaaaagtacatcatgactcgtctctataaatatgtattctgtccagaaactactgatgatgagaagaaagatcttgccattcaaaagagaatcagagccctgcgctgggttacgcctcagatgctgtgtgtccctgttaatgaagacatcccagaagtgtctgatatggtggtgaaggcgatcacagatatcattgaaatggattccaagcgtgtgcctcgagacaagctggcctgcatcaccaagtgcagcaagcacatcttcaatgccatcaagatcaccaagaatgagccggcgtcagcggatgacttcctccccaccctcatctacattgttttgaagggcaaccccccacgccttcagtctaatatccagtatatcacgcgcttctgcaatccaagccgactgatgactggagaggatggctactatttcaccaatctgtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagagcattttttaaaggtacagtatatggggattgtttcgtttttcctagcaggggaaccttagttaataataaaatactacttatttgagttactgatacagattcatttaaggcttgtgtgcaaattttgtctcaatcttttttccctccatgattttcctatgtgcttcctctggcattcactgtggttttggtaaataattgccttttaaaggattaaacaaatgaatgctacaaagtgtatgttcaagaaaattaaatggtaccactcttccacagtttggaataattttataattgtaaagatagaaattatattgataagtaaatatgtaaaattgtaaatatgtaaaaaaaagaatggtgtctgctgtgcatggcattttatatgttaattttttagtttaaaatgaagtatattgaatgtttgcctttagcaccattttatttggtttgtcccactaaaatgactcgagaagtgtttagacaaactccccttaagatgtgcactccatctttaagaacgtgttagccttaactttgaggttctatatagtcagagactatgacaccactaaggttcagaataaagtttaggccacataaaattgctgtttaatgtagtcgatggaagactttaaactatgcttctagcttatttttccctcattcattcagcaaatctctattgagttcttcagtgagaaggagcaggcactgggcctggaatggaaggcgggaatgaatgggcctctgatggtgagaggtgacggggtccctcagctgtgagatgcaaggggcgccttgcagcctccataatatacatttgactttgcaaacgtctagacatgttttctgaacctttttcaggacatttcaacctcgggactattcatattagtggcctgagaggtgtttgttgtggggccaccctgtgcatggtagaatgttcagcagcattcctgccatccatatccattaggtgccagtagcacccccgctagagctgtgaaaaattctctccagacatagtcagatgtctcctggggccatatcacccctccgttaagaaccactgatgtcttttacaaaccaggagttatcctcctggtggttaatatggtgtaaccaaagaatcttgcactcaatgcacagtgtgatgttaactaaaacgagttaaatatttaggaggcttgacagctacctgcattgtagaaccttttcttatctcagtggaaccttctataacctaaatataccattgatgattcttcttccattcagtgacatccacagattatgcagctatacttgtgaaatcgtgcatgaggccccagggcaccgttctagaacaacgtcacttcacacaggcagctgagaaaggttctcttgcttttccagtatcttcctaaggatggagcccaaaattgcagagcagtaactttggaataaaaccagggtgggtataaaacttcttattcttaaatttacatataagatctattaagcttgacacatctgtgtcatcacgcactgaagacaggaagcagttcactgagtcagctggttcccaagctcgcacagaaggtgataagttactatcaaatgccagtgagaatcttcttatagaataacctgggcccaagtgattttagtacaaaacttgcccttctttggtttaattttctatgtgcttttaggtgtgaatccagatatgcggtcttaattcctttggaaatacacagttcgtttagttactgtacactctgtttgttcaataaactgcatatcaacttcccacaaaagctgacttttttgggtctcttacatataaagtaggttattgagttgatttttttggaggtatctcatattggtcgaattcttctggtatggactcttgccttatatagaggcttctatttctcttaagtcagcatcaatacaacggccggagtttctgtttttgcaataagaagatgttggtattttatgtagggtaaatgtgactggaatacacctttggaacggaattctttatcaataaagtttcacaatccgtccctcttcca

SEQ ID NO: 436896 - DNA, 1089 bp, Homo sapiens
ggctagcaggagggtgtgtgtggggcgggagcggacaacggagaccagacctactgcagccacgcgggcgagcggctgtgtggatgtcggcgaagccgcgggcgagggccttgggaactccaagacagaatggcccgaggcctggacactctctgaggacatctctgcaaaggccccagcggcccagatcactttgggaagcagtgacatccaacctgtatcaagtcttctaatctgtgaacatgagatgggtctcggctgtgttacctaagctggagtgcagtggctattcccagcacaatcatagtgcactacagtctccaactcctgggttcaggtgctccttgtgcctccgcctcctgaatagctgggattgcaggcatgtgccatcatgcctggctatgtgccttcaaaaagactacagttgtggatggagtgttttatcaatattagttggtttatgattgtgtttagttccatatcctagctgattttctatctgttctgtccattcttgaagagtccaactataattttgagtttgtctatttctcctcaagttctgtcagttttgctgtatatatttgaggtctgtttttagatgtgtacacattttaaatggtgttgggtctttaccattatgtaatgtccctcttaatctattgtaaatttccttgctttgaggtatagtttgtcttatgtaaatataatcagttcagttttcctttgaccagcatttacgtaacatatctttttccatttttaaacttataatctacctatattaaaatatatagtcaggccaggtgctgggattacaggcgtgagccactgcatgtggctgctctctgttttttatgcctcactgtttcctttcctgccttcttttgggttatttgactattgcttagtattcaattttaatttatcaattgattattttattatatctctttgtgtagtgttctttagtggtggctctaagaattacagtatgtacaccaaactttttactttctgcttagaattaatattttaccacttgtaaaatgtaggaacctggctatcatgtaggttcctttcccctgt

SEQ ID NO: 436897 - DNA, 854 bp, Homo sapiens
ggctagcaggagggtgtgtgtggggcgggagcggacaacggagaccagacctactgcagccacgcgggcgagcggctgtgtggatgtcggcgaagccgcgggcgagggccttgggaactccaagacagaatggcccgaggcctggacactctctgaggacatctctgcaaaggccccagcggcccagatcactttgggaagcagtgacatccaacctgtatcaagtcttctaatctgtgaacatggctggagtgcagtgtcgtgatcacagcccactgcagcctcgacctcccgggctgaagggatcctcgcacctcagcctcctgagtagctgagactataggctggagtaccatgacaggatcctagctcactgcatcctcaaactcatgggctcaagtgattctcctgctttagtctcccgagtagctgggactacagagatgggtctcggctgtgttacctaagctggagtgcagtggctattcccagcacaatcatagtgcactacagtctccaactcctgggttcaggtgctccttgtgcctccgcctcctgaatagctgggattgtgctgggattacaggcgtgagccactgcatgtggctgctctctgttttttatgcctcactgtttcctttcctgccttcttttgggttatttgactattgcttagtattcaattttaatttatcaattgattattttattatatctctttgtgtagtgttctttagtggtggctctaagaattacagtatgtacaccaaactttttactttctgcttagaattaatattttaccacttgtaaaatgtaggaacctggctatcatgtaggttcctttcccctgt

SEQ ID NO: 436898 - DNA, 3081 bp, Homo sapiens
ggcgggcgccgggcgccgggcgcgcggtcctgcgaggagacgtggcagagtgcggctgcgctcgcgccggaccggaaagccggggaagtggccgaggagggagggctgcgagccatggcgaccaagacggcgggcgtggggcggtgggaggtagtgaagaagggtcggcggcctggggtcggcgccggcgccggcggccgaggaggcggcaggaaccgcagggcgctcggggaagcaaacggagtgtggaaatacgacctgacccctgcaatccagaccacaagcaccctttatgagcggggctttgagaatatcatgaagcggcagaataaggagcaggtcccaccccctgctgtggaacctaagaaaccagggaacaagaagcagccaaagaaggtggcaactcctcccaaccaaaaccagaagcagggccgcttccgcagcctggaggaagcactgaaagctctggatgtggcagacctgcagaaggaactggacaagagccagagtgtgttctctggaaacccatccatatggttgaaggacctggccagctatctcaactacaagctacaagctcctctaagtgaacccacgctgagccagcatactcatgattatccctacagcctggtgagccgggagctacgtgggatcatccgagggctgctggcgaaggcagcagggtctctggagctcttttttgaccactgtctgttcaccatgttgcaagagctggataagacaccaggggagtcactacatggttaccgcatctgtatccaggccatcctgcaagacaagcccaagattgccacggcaaacctaggcaagttcctggaactgctgaggtcccaccagagccgaccagcaaagtgtctcaccatcatgtgggccctgggtcaagcaggttttgccaacctcaccgagggactgaaagtgtggctggggatcatgctgcctgtgctgggcatcaagtctctgtctccctttgccatcacatacctggatcggctgctcctgatgcatcccaaccttaccaagggcttcggcatgattggccccaaggacttcttcccacttctggactttgcctatatgccgaacaactccctgacacccagcctgcaggagcagctgtgtcagctctacccccgactgaaagtgctggcatttggagcaaagccggattccaccctgcatacctacttcccttctttcctgtccagagccacccctagctgtccccctgagatgaagaaagagctcctgagcagcctgactgagtgcctgacggtggaccccctcagtgccagcgtctggaggcagctgtaccctaagcacctgtcacagtccagccttctgctggagcacttgctcagctcctgggagcagattcccaagaaggtacagaagtctttgcaagaaaccattcagtccctcaagcttaccaaccaggagctgctgaggaagggtagcagtaacaaccaggatgtcgtcacctgtgacatggcctgcaagggcctgttgcagcaggttcagggtcctcggctgccctggacgcggctcctcctgttgctgctggtcttcgctgtaggcttcctgtgccatgacctccggtcacacagctccttccaggcctcccttactggccggttgcttcgatcatctggcttcttacctgctagccaacaagcgtgtgccaagctctactcctacagtctgcaaggctacagctggctgggggagacactgccgctctggggctcccacctgctcaccgtggtgcggcccagcttgcagctggcctgggctcacaccaatgccacagtcagcttcctttctgcccactgtgcctctcaccttgcgtggtttggtgacagtctcaccagtctctctcagaggctacagatccagctccccgattccgtgaatcagctactccgctatctgagagagctgcccctgcttttccaccagaatgtgctgctgccactgtggcacctcttgcttgaggccctggcctgggcccaggagcactgccatgaggcatgcagaggtgaggtgacctgggactgcatgaagacacagctcagtgaggctgtccactggacctggctttgcctacaggacattacagtggctttcttggactgggcacttgccctgatatcccagcagtaggccctgccttcctggccactgatttctgcatgggtagaccatccaagactgcagcgggtagaaggtggcagttcttcatgggagtctttttaacttggtgcctgagttctctcctaggcaagtggccagttgcctccacctcagttcttccatctttggtggggacagggcccagcagcatctcagcctcctacccacaattccactgaacacttttctggccctactgcacatggcccccagcctccatccttgtgctggtagcctctcacaactccgcccttgccctctgccttccacttccttccatctcatttctaaaccccaaacagctcatctctaaaaagatagaactcccagcaggtggcttctgtgttcttctgacaaatgattcctgcttctccagactttagcagcctcctgttcccattcttggtcacagctctagccacagcagaaggaaaggggcttccagaagaatatagcaccgcattgggaaacagcagcctcacctccacctgaagcctgggtgtggctgtcagtggacatggggagctggatggaaatgcctctcacttcaaaatgcccagcctgccccaaatgcctctaagcccctccctgtcccctcccttgtagtcctacttcttccaactttccattccccatcatgctgggggtcttggtcacaaggctcagcttctctccactgtccatccctcctatcatctgtagagcagagcacaggcagttgtgtgccttgggcccagggaaccctccatcaacctgagacaggactcagtatatggttcttgggtatgccctaccaggtggaataaaggacagattcgagaacaacaaaacacagaagcgacgctcattggggacacaagtagaagg

SEQ ID NO: 436899 - DNA, 3057 bp, Homo sapiens
agggctgcgatccatggtgtccatcacggcggccgtggttgcggcgtgacgcgatagtgaatagatggtcaggtggtctgtattctgagctcggcgtccgtgcggtcgagggatgcgggatcgatatcctgacaggggctgcgtcgaggtgaagacaaactggatatgctgtgaaaattctaccgtgacccgcaatgctattcctatcatgctagcgaagtcgaccactatttatgcaagcagagaggtattcttgacgagataattatctagaagctggtaagagtaaagtgatgcaagagtcccaacaccctcgtggtatagtagtagatccataactaagactcgacgggaatagcatatgacatgcatgtgcagaagtaaggggtcgtgctaacttgacctacctcgaattcaatagaccagtaattctgggaccgcgtatcctggacatgactaggaggaagcactgaaagctctggatgtggcagacctgcagaaggaactggacaagagccagagtgtgttctctggaaacccatccatatggttgaaggacctggccagctatctcaactacaagctacaagctcctctaagtgaacccacgctgagccagcatactcatgattatccctacagcctggtgagccgggagctacgtgggatcatccgagggctgctggcgaaggcagcagggtctctggagctcttttttgaccactgtctgttcaccatgttgcaagagctggataagacaccaggggagtcactacatggttaccgcatctgtatccaggccatcctgcaagacaagcccaagattgccacggcaaacctaggcaagttcctggaactgctgaggtcccaccagagccgaccagcaaagtgtctcaccatcatgtgggccctgggtcaagcaggttttgccaacctcaccgagggactgaaagtgtggctggggatcatgctgcctgtgctgggcatcaagtctctgtctccctttgccatcacatacctggatcggctgctcctgatgcatcccaaccttaccaagggcttcggcatgattggccccaaggacttcttcccacttctggactttgcctatatgccgaacaactccctgacacccagcctgcaggagcagctgtgtcagctctacccccgactgaaagtgctggcatttggagcaaagccggattccaccctgcatacctacttcccttctttcctgtccagagccacccctagctgtccccctgagatgaagaaagagctcctgagcagcctgactgagtgcctgacggtggaccccctcagtgccagcgtctggaggcagctgtaccctaagcacctgtcacagtccagccttctgctggagcacttgctcagctcctgggagcagattcccaagaaggtacagaagtctttgcaagaaaccattcagtccctcaagcttaccaaccaggagctgctgaggaagggtagcagtaacaaccaggatgtcgtcacctgtgacatggcctgcaagggcctgttgcagcaggttcagggtcctcggctgccctggacgcggctcctcctgttgctgctggtcttcgctgtaggcttcctgtgccatgacctccggtcacacagctccttccaggcctcccttactggccggttgcttcgatcatctggcttcttacctgctagccaacaagcgtgtgccaagctctactcctacagtctgcaaggctacagctggctgggggagacactgccgctctggggctcccacctgctcaccgtggtgcggcccagcttgcagctggcctgggctcacaccaatgccacagtcagcttcctttctgcccactgtgcctctcaccttgcgtggtttggtgacagtctcaccagtctctctcagaggctacagatccagctccccgattccgtgaatcagctactccgctatctgagagagctgcccctgcttttccaccagaatgtgctgctgccactgtggcacctcttgcttgaggccctggcctgggcccaggagcactgccatgaggcatgcagaggtgaggtgacctgggactgcatgaagacacagctcagtgaggctgtccactggacctggctttgcctacaggacattacagtggctttcttggactgggcacttgccctgatatcccagcagtaggccctgccttcctggccactgatttctgcatgggtagaccatccaagactgcagcgggtagaaggtggcagttcttcatgggagtctttttaacttggtgcctgagttctctcctaggcaagtggccagttgcctccacctcagttcttccatctttggtggggacagggcccagcagcatctcagcctcctacccacaattccactgaacacttttctggccctactgcacatggcccccagcctccatccttgtgctggtagcctctcacaactccgcccttgccctctgccttccacttccttccatctcatttctaaaccccaaacagctcatctctaaaaagatagaactcccagcaggtggcttctgtgttcttctgacaaatgattcctgcttctccagactttagcagcctcctgttcccattcttggtcacagctctagccacagcagaaggaaaggggcttccagaagaatatagcaccgcattgggaaacagcagcctcacctccacctgaagcctgggtgtggctgtcagtggacatggggagctggatggaaatgcctctcacttcaaaatgcccagcctgccccaaatgcctctaagcccctccctgtcccctcccttgtagtcctacttcttccaactttccattccccatcatgctgggggtcttggtcacaaggctcagcttctctccactgtccatccctcctatcatctgtagagcagagcacaggcagttgtgtgccttgggcccagggaaccctccatcaacctgagacaggactcagtatatggttcttgggtatgccctaccaggtggaataaaggacacagatttgatttctagca

SEQ ID NO: 436900 - DNA, 2909 bp, Homo sapiens
ggcgggcgccgggcgccgggcgcgcggtcctgcgaggagacgtggcagagtgcggctgcgctcgcgccggaccggaaagccggggaagtggccgaggagggagggctgcgagccatggcgaccaagacggcgggcgtggggcggtgggaggtagtgaagaagggtcggcggcctggggtcggcgccggcgccggcggccgaggaggcggcaggaaccgcagggcgctcggggaagcaaacggagtgtggaaatacgacctgacccctgcaatccagaccacaagcaccctttatgagcggggctttgagaatatcatgaagcggcagaataaggagcaggtcccaccccctgctgtggaacctaagaaaccagggaacaagaagcagccaaagaaggtggcaactcctcccaaccaaaaccagaagcagggccgcttccgcagcctggaggaagcactgaaagctctggatgtggcagacctgcagaaggaactggacaagagccagagtgtgttctctggaaacccatccatatggttgaaggacctggccagctatctcaactacaagctacaagctcctctaagtgaacccacgctgagccagcatactcatggggagtcactacatggttaccgcatctgtatccaggccatcctgcaagacaagcccaagattgccacggcaaacctaggcaagttcctggaactgctgaggtcccaccagagccgaccagcaaagtgtctcaccatcatgtgggccctgggtcaagcaggttttgccaacctcaccgagggactgaaagtgtggctggggatcatgctgcctgtgctgggcatcaagtctctgtctccctttgccatcacatacctggatcggctgctcctgatgcatcccaaccttaccaagggcttcggcatgattggccccaaggacttcttcccacttctggactttgcctatatgccgaacaactccctgacacccagcctgcaggagcagctgtgtcagctctacccccgactgaaagtgctggcatttggagcaaagccggattccaccctgcatacctacttcccttctttcctgtccagagccacccctagctgtccccctgagatgaagaaagagctcctgagcagcctgactgagtgcctgacggtggaccccctcagtgccagcgtctggaggcagctgtaccctaagcacctgtcacagtccagccttctgctggagcacttgctcagctcctgggagcagattcccaagaaggtacagaagtctttgcaagaaaccattcagtccctcaagcttaccaaccaggagctgctgaggaagggtagcagtaacaaccaggatgtcgtcacctgtgacatggcctgcaagggcctgttgcagcaggttcagggtcctcggctgccctggacgcggctcctcctgttgctgctggtcttcgctgtaggcttcctgtgccatgacctccggtcacacagctccttccaggcctcccttactggccggttgcttcgatcatctggcttcttacctgctagccaacaagcgtgtgccaagctctactcctacagtctgcaaggctacagctggctgggggagacactgccgctctggggctcccacctgctcaccgtggtgcggcccagcttgcagctggcctgggctcacaccaatgccacagtcagcttcctttctgcccactgtgcctctcaccttgcgtggtttggtgacagtctcaccagtctctctcagaggctacagatccagctccccgattccgtgaatcagctactccgctatctgagagagctgcccctgcttttccaccagaatgtgctgctgccactgtggcacctcttgcttgaggccctggcctgggcccaggagcactgccatgaggcatgcagaggtgaggtgacctgggactgcatgaagacacagctcagtgaggctgtccactggacctggctttgcctacaggacattacagtggctttcttggactgggcacttgccctgatatcccagcagtaggccctgccttcctggccactgatttctgcatgggtagaccatccaagactgcagcgggtagaaggtggcagttcttcatgggagtctttttaacttggtgcctgagttctctcctaggcaagtggccagttgcctccacctcagttcttccatctttggtggggacagggcccagcagcatctcagcctcctacccacaattccactgaacacttttctggccctactgcacatggcccccagcctccatccttgtgctggtagcctctcacaactccgcccttgccctctgccttccacttccttccatctcatttctaaaccccaaacagctcatctctaaaaagatagaactcccagcaggtggcttctgtgttcttctgacaaatgattcctgcttctccagactttagcagcctcctgttcccattcttggtcacagctctagccacagcagaaggaaaggggcttccagaagaatatagcaccgcattgggaaacagcagcctcacctccacctgaagcctgggtgtggctgtcagtggacatggggagctggatggaaatgcctctcacttcaaaatgcccagcctgccccaaatgcctctaagcccctccctgtcccctcccttgtagtcctacttcttccaactttccattccccatcatgctgggggtcttggtcacaaggctcagcttctctccactgtccatccctcctatcatctgtagagcagagcacaggcagttgtgtgccttgggcccagggaaccctccatcaacctgagacaggactcagtatatggttcttgggtatgccctaccaggtggaataaaggacacagatttgatttctagca

SEQ ID NO: 436901 - DNA, 3122 bp, Homo sapiens
ggcgggcgccgggcgccgggcgcgcggtcctgcgaggagacgtggcagagtgcggctgcgctcgcgccggaccggaaagccggggaagtggccgaggagggagggctgcgagccatggcgaccaagacggcgggcgtggggcggtgggaggtagtgaagaagggtcggcggcctggggtcggcgccggcgccggcggccgaggaggcggcaggaaccgcagggcgctcggggaagcaaacggagtgtggaaatacgacctgacccctgcaatccagaccacaagcaccctttatgagcggggctttgagaatatcatgaagcggcagaataaggagcaggtcccaccccctgctgtggaacctaagaaaccagggaacaagaagcagccaaagaaggtggcaactcctcccaaccaaaaccagaagcagggccgcttccgcagcctggaggaagcactgaaagctctggatgtggcagacctgcagaaggaactggacaagagccagagtgtgttctctggaaacccatccatatggttgaaggacctggccagctatctcaactacaagctacaagctcctctaagtgaacccacgctgagccagcatactcatgattatccctacagcctggtgagccgggagctacgtgggatcatccgagggctgctggcgaaggcagcagggtctctggagctcttttttgaccactgtctgttcaccatgttgcaagagctggataagacaccaggggagtcactacatggttaccgcatctgtatccaggccatcctgcaagacaagcccaagattgccacggcaaacctaggcaagttcctggaactgctgaggtcccaccagagccgaccagcaaagtgtctcaccatcatgtgggccctgggtcaagcaggttttgccaacctcaccgagggactgaaagtgtggctggggatcatgctgcctgtgctgggcatcaagtctctgtctccctttgccatcacatacctggatcggctgctcctgatgcatcccaaccttaccaagggcttcggcatgattggccccaaggacttcttcccacttctggactttgcctatatgccgaacaactccctgacacccagcctgcaggagcagctgtgtcagctctacccccgactgaaagtgctggcatttggagcaaagccggattccaccctgcatacctacttcccttctttcctgtccagagccacccctagctgtccccctgagatgaagaaagagctccctgttgacagctgcctgccccgctcactcgagcttcaccctcagaagatggatcccaagagacagcacattcagctcctgagcagcctgactgagtgcctgacggtggaccccctcagtgccagcgtctggaggcagctgtaccctaagcacctgtcacagtccagccttctgctggagcacttgctcagctcctgggagcagattcccaagaaggtacagaagtctttgcaagaaaccattcagtccctcaagcttaccaaccaggagctgctgaggaagggtagcagtaacaaccaggatgtcgtcacctgtgacatggcctgcaagggcctgttgcagcaggttcagggtcctcggctgccctggacgcggctcctcctgttgctgctggtcttcgctgtaggcttcctgtgccatgacctccggtcacacagctccttccaggcctcccttactggccggttgcttcgatcatctggcttcttacctgctagccaacaagcgtgtgccaagctctactcctacagtctgcaaggctacagctggctgggggagacactgccgctctggggctcccacctgctcaccgtggtgcggcccagcttgcagctggcctgggctcacaccaatgccacagtcagcttcctttctgcccactgtgcctctcaccttgcgtggtttggtgacagtctcaccagtctctctcagaggctacagatccagctccccgattccgtgaatcagctactccgctatctgagagagctgcccctgcttttccaccagaatgtgctgctgccactgtggcacctcttgcttgaggccctggcctgggcccaggagcactgccatgaggcatgcagaggtgaggtgacctgggactgcatgaagacacagctcagtgaggctgtccactggacctggctttgcctacaggacattacagtggctttcttggactgggcacttgccctgatatcccagcagtaggccctgccttcctggccactgatttctgcatgggtagaccatccaagactgcagcgggtagaaggtggcagttcttcatgggagtctttttaacttggtgcctgagttctctcctaggcaagtggccagttgcctccacctcagttcttccatctttggtggggacagggcccagcagcatctcagcctcctacccacaattccactgaacacttttctggccctactgcacatggcccccagcctccatccttgtgctggtagcctctcacaactccgcccttgccctctgccttccacttccttccatctcatttctaaaccccaaacagctcatctctaaaaagatagaactcccagcaggtggcttctgtgttcttctgacaaatgattcctgcttctccagactttagcagcctcctgttcccattcttggtcacagctctagccacagcagaaggaaaggggcttccagaagaatatagcaccgcattgggaaacagcagcctcacctccacctgaagcctgggtgtggctgtcagtggacatggggagctggatggaaatgcctctcacttcaaaatgcccagcctgccccaaatgcctctaagcccctccctgtcccctcccttgtagtcctacttcttccaactttccattccccatcatgctgggggtcttggtcacaaggctcagcttctctccactgtccatccctcctatcatctgtagagcagagcacaggcagttgtgtgccttgggcccagggaaccctccatcaacctgagacaggactcagtatatggttcttgggtatgccctaccaggtggaataaaggacacagatttgatttctagca

SEQ ID NO: 436902 - DNA, 3234 bp, Homo sapiens
ggcgggcgccgggcgccgggcgcgcggtcctgcgaggagacgtggcagagtgcggctgcgctcgcgccggaccggaaagccggggaagtggccgaggagggagggctgcgagccatggcgaccaagacggcgggcgtggggcggtgggaggtagtgaagaagggtcggcggcctggggtcggcgccggcgccggcggccgaggaggcggcaggaaccgcagggcgctcggggaagcaaacggagtgtggaaatacgacctgacccctgcaatccagaccacaagcaccctttatgagcggggctttgagaatatcatgaagcggcagaataaggagcaggtcccaccccctgctgtggaacctaagaaaccagggaacaagaagcagccaaagaaggtggcaactcctcccaaccaaaaccagaagcagggccgcttccgcagcctggaggaagcactgaaagctctggatgtggcagacctgcagaaggaactggacaagagccagagtgtgttctctggaaacccatccatatggttgaaggacctggccagctatctcaactacaagctacaagctcctctaagtgaacccacgctgagccagcatactcatgattatccctacagcctggtgagccgggagctacgtgggatcatccgagggctgctggcgaaggcagcagggtctctggagctcttttttgaccactgtctgttcaccatgttgcaagagctggataagacaccaggggagtcactacatggttaccgcatctgtatccaggccatcctgcaagacaagcccaagattgccacggcaaacctaggcaagttcctggaactgctgaggtcccaccagagccgaccagcaaagtgtctcaccatcatgtgggccctgggtcaagcaggttttgccaacctcaccgagggactgaaagtgtggctggggatcatgctgcctgtgctgggcatcaagtctctgtctccctttgccatcacatacctggatcggctgctcctgatgcatcccaaccttaccaagggcttcggcatgattggccccaaggacttcttcccacttctggactttgcctatatgccgaacaactccctgacacccagcctgcaggagcagctgtgtcagctctacccccgactgaaagtgctggcatttggagcaaagccggattccaccctgcatacctacttcccttctttcctgtccagagccacccctagctgtccccctgagatgaagaaagaggtgaggatatggtgggaggctttttctccttccccaggggtcagctgtagcggtccctatctgctgacaaaggccttgccttcacagagcccattctgaggcttttccttagctccctgttgacagctgcctgccccgctcactcgagcttcaccctcagaagatggatcccaagagacagcacattcagctcctgagcagcctgactgagtgcctgacggtggaccccctcagtgccagcgtctggaggcagctgtaccctaagcacctgtcacagtccagccttctgctggagcacttgctcagctcctgggagcagattcccaagaaggtacagaagtctttgcaagaaaccattcagtccctcaagcttaccaaccaggagctgctgaggaagggtagcagtaacaaccaggatgtcgtcacctgtgacatggcctgcaagggcctgttgcagcaggttcagggtcctcggctgccctggacgcggctcctcctgttgctgctggtcttcgctgtaggcttcctgtgccatgacctccggtcacacagctccttccaggcctcccttactggccggttgcttcgatcatctggcttcttacctgctagccaacaagcgtgtgccaagctctactcctacagtctgcaaggctacagctggctgggggagacactgccgctctggggctcccacctgctcaccgtggtgcggcccagcttgcagctggcctgggctcacaccaatgccacagtcagcttcctttctgcccactgtgcctctcaccttgcgtggtttggtgacagtctcaccagtctctctcagaggctacagatccagctccccgattccgtgaatcagctactccgctatctgagagagctgcccctgcttttccaccagaatgtgctgctgccactgtggcacctcttgcttgaggccctggcctgggcccaggagcactgccatgaggcatgcagaggtgaggtgacctgggactgcatgaagacacagctcagtgaggctgtccactggacctggctttgcctacaggacattacagtggctttcttggactgggcacttgccctgatatcccagcagtaggccctgccttcctggccactgatttctgcatgggtagaccatccaagactgcagcgggtagaaggtggcagttcttcatgggagtctttttaacttggtgcctgagttctctcctaggcaagtggccagttgcctccacctcagttcttccatctttggtggggacagggcccagcagcatctcagcctcctacccacaattccactgaacacttttctggccctactgcacatggcccccagcctccatccttgtgctggtagcctctcacaactccgcccttgccctctgccttccacttccttccatctcatttctaaaccccaaacagctcatctctaaaaagatagaactcccagcaggtggcttctgtgttcttctgacaaatgattcctgcttctccagactttagcagcctcctgttcccattcttggtcacagctctagccacagcagaaggaaaggggcttccagaagaatatagcaccgcattgggaaacagcagcctcacctccacctgaagcctgggtgtggctgtcagtggacatggggagctggatggaaatgcctctcacttcaaaatgcccagcctgccccaaatgcctctaagcccctccctgtcccctcccttgtagtcctacttcttccaactttccattccccatcatgctgggggtcttggtcacaaggctcagcttctctccactgtccatccctcctatcatctgtagagcagagcacaggcagttgtgtgccttgggcccagggaaccctccatcaacctgagacaggactcagtatatggttcttgggtatgccctaccaggtggaataaaggacacagatttgatttctagca

SEQ ID NO: 436903 - DNA, 2151 bp, Homo sapiens
cagtaggtgcaagcctgaggcctccctcgtgacttttacccctgcagtgtggctggggatcatgctgcctgtgctgggcatcaagtctctgtctccctttgccatcacatacctggatcggctgctcctgatgcatcccaaccttaccaagggcttcggcatgattggccccaaggacttcttcccacttctggactttgcctatatgccgaacaactccctgacacccagcctgcaggagcagctgtgtcagctctacccccgactgaaagtgctggcatttggagcaaagccggattccaccctgcatacctacttcccttctttcctgtccagagccacccctagctgtccccctgagatgaagaaagagctcctgagcagcctgactgagtgcctgacggtggaccccctcagtgccagcgtctggaggcagctgtaccctaagcacctgtcacagtccagccttctgctggagcacttgctcagctcctgggagcagattcccaagaaggtacagaagtctttgcaagaaaccattcagtccctcaagcttaccaaccaggagctgctgaggaagggtagcagtaacaaccaggatgtcgtcacctgtgacatggcctgcaagggcctgttgcagcaggttcagggtcctcggctgccctggacgcggctcctcctgttgctgctggtcttcgctgtaggcttcctgtgccatgacctccggtcacacagctccttccaggcctcccttactggccggttgcttcgatcatctggcttcttacctgctagccaacaagcgtgtgccaagctctactcctacagtctgcaaggctacagctggctgggggagacactgccgctctggggctcccacctgctcaccgtggtgcggcccagcttgcagctggcctgggctcacaccaatgccacagtcagcttcctttctgcccactgtgcctctcaccttgcgtggtttggtgacagtctcaccagtctctctcagaggctacagatccagctccccgattccgtgaatcagctactccgctatctgagagagctgcccctgcttttccaccagaatgtgctgctgccactgtggcacctcttgcttgaggccctggcctgggcccaggagcactgccatgaggcatgcagaggtgaggtgacctgggactgcatgaagacacagctcagtgaggctgtccactggacctggctttgcctacaggacattacagtggctttcttggactgggcacttgccctgatatcccagcagtaggccctgccttcctggccactgatttctgcatgggtagaccatccaagactgcagcgggtagaaggtggcagttcttcatgggagtctttttaacttggtgcctgagttctctcctaggcaagtggccagttgcctccacctcagttcttccatctttggtggggacagggcccagcagcatctcagcctcctacccacaattccactgaacacttttctggccctactgcacatggcccccagcctccatccttgtgctggtagcctctcacaactccgcccttgccctctgccttccacttccttccatctcatttctaaaccccaaacagctcatctctaaaaagatagaactcccagcaggtggcttctgtgttcttctgacaaatgattcctgcttctccagactttagcagcctcctgttcccattcttggtcacagctctagccacagcagaaggaaaggggcttccagaagaatatagcaccgcattgggaaacagcagcctcacctccacctgaagcctgggtgtggctgtcagtggacatggggagctggatggaaatgcctctcacttcaaaatgcccagcctgccccaaatgcctctaagcccctccctgtcccctcccttgtagtcctacttcttccaactttccattccccatcatgctgggggtcttggtcacaaggctcagcttctctccactgtccatccctcctatcatctgtagagcagagcacaggcagttgtgtgccttgggcccagggaaccctccatcaacctgagacaggactcagtatatggttcttgggtatgccctaccaggtggaataaaggacacagatttgatttctagca

SEQ ID NO: 436904 - DNA, 2430 bp, Homo sapiens
  misc_feature (2416)..(2416): n is a, c, g, or t
ggcgggcgccgggcgccgggcgcgcggtcctgcgaggagacgtggcagagtgcggctgcgctcgcgccggaccggaaagccggggaagtggccgaggagggagggctgcgagccatggcgaccaagacggcgggcgtggggcggtgggaggtagtgaagaagggtcggcggcctggggtcggcgccggcgccggcggccgaggaggcggcaggaaccgcagggcgctcggggaagcaaacggagtgtggaaatacgacctgacccctgcaatccagaccacaagcaccctttatgagcggggctttgagaatatcatgaagcggcagaataaggagcaggtcccaccccctgctgtggaacctaagaaaccagggaacaagaagcagccaaagaaggtggcaactcctcccaaccaaaaccagaagcagggccgcttccgcagcctggaggaagcactgaaagctctggatgtggcagacctgcagaaggaactggacaagagccagagtgtgttctctggaaacccatccatatggttgaaggacctggccagctatctcaactacaagctacaagctcctctaagtgaacccacgctgagccagcatactcatgattatccctacagcctggtgagccgggagctacgtgggatcatccgagggctgctggcgaaggcagcagggtctctggagctcttttttgaccactgtctgttcaccatgttgcaagagctggataagacaccaggggagtcactacatggttaccgcatctgtatccaggccatcctgcaagacaagcccaagattgccacggcaaacctaggcaagttcctggaactgctgaggtcccaccagagccgaccagcaaagtgtctcaccatcatgtgggccctgggtcaagcaggttttgccaacctcaccgagggactgaaagtgtggctggggatcatgctgcctgtgctgggcatcaagtctctgtctccctttgccatcacatacctggatcggctgctcctgatgcatcccaaccttaccaagggcttcggcatgattggccccaaggacttcttcccacttctggactttgcctatatgccgaacaactccctgacacccagcctgcaggagcagctgtgtcagctctacccccgactgaaagtgctggcatttggagcaaagccggattccaccctgcatacctacttcccttctttcctgtccagagccacccctagctgtccccctgagatgaagaaagagctcctgagcagcctgactgagtgcctgacggtggaccccctcagtgccagcgtctggaggcagctgtaccctaagcacctgtcacagtccagccttctgctggagcacttgctcagctcctgggagcagattcccaagaaggtacagaagtctttgcaagaaaccattcagtccctcaagcttaccaaccaggagctgctgaggaagggtagcagtaacaaccaggatgtcgtcacctgtgacatggcctgcaagggcctgttgcagcaggttcagggtcctcggctgccctggacgcggctcctcctgttgctgctggtcttcgctgtaggcttcctgtgccatgacctccggtcacacagctccttccaggcctcccttactggccggttgcttcgatcatctggcttcttacctgctagccaacaagcgtgtgccaagctctactcctacagtctgcaaggctacagctggctgggggagacactgccgctctggggctcccacctgctcaccgtggtgcggcccagcttgcagctggcctgggctcacaccaatgccacagtcagcttcctttctgcccactgtgcctctcaccttgcgtggtttggtgacagtctcaccagtctctctcagaggctacagatccagctccccgattccgtgaatcagctactccgctatctgagagagctgcccctgcttttccaccagaatgtgctgctgccactgtggcacctcttgcttgaggccctggcctgggcccaggagcactgccatgaggcatgcagaggtgaggtgacctgggactgcatgaagacacagctcagtgaggctgtccactggacctggctttgcctacaggacattacagtggctttcttggactgggcacttgccctgatatcccagcagtaggccctgccttcctggccactgatttctgcatgggtagaccatccaagactgcagcgggtagaaggtggcagttcttcatgggagtctttttaacttggtgcctgagttctctcctaggcaagtggccagtgctcactcagtctcatcttgtgggaaggccagagataagctctacacatcatgaaattctgctatgaatgcccactcatctggtgtagcttaatcgctgctngtcatctatatcac

SEQ ID NO: 436905 - DNA, 1658 bp, Homo sapiens
ggcgggcgccgggcgccgggcgcgcggtcctgcgaggagacgtggcagagtgcggctgcgctcgcgccggaccggaaagccggggaagtggccgaggagggagggctgcgagccatggcgaccaagacggcgggcgtggggcggtgggaggtagtgaagaagggtcggcggcctggggtcggcgccggcgccggcggccgaggaggcggcaggaaccgcagggcgctcggggaagcaaacggagtgtggaaatacgacctgacccctgcaatccagaccacaagcaccctttatgagcggggctttgagaatatcatgaagcggcagaataaggagcaggtcccaccccctgctgtggaacctaagaaaccagggaacaagaagcagccaaagaaggtggcaactcctcccaaccaaaaccagaagcagggccgcttccgcagcctggaggaagcactgaaagctctggatgtggcagacctgcagaaggaactggacaagagccagagtgtgttctctggaaacccatccatatggttgaaggacctggccagctatctcaactacaagctacaagctcctctaagtgaacccacgctgagccagcatactcatgattatccctacagcctggtgagccgggagctacgtgggatcatccgagggctgctggcgaaggcagcagggtctctggagctcttttttgaccactgtctgttcaccatgttgcaagagctggataagacaccaggggagtcactacatggttaccgcatctgtatccaggccatcctgcaagacaagcccaagattgccacggcaaacctaggcaagttcctggaactgctgaggtcccaccagagccgaccagcaaagtgtctcaccatcatgtgggccctgggtcaagcaggttttgccaacctcaccgagggactgaaagtgtggctggggatcatgctgcctgtgctgggcatcaagtctctgtctccctttgccatcacatacctggatcggctgctcctgatgcatcccaaccttaccaagggcttcggcatgattggccccaaggacttcttcccacttctggactttgcctatatgccgaacaactccctgacacccagcctgcaggagcagctgtgtcagctctacccccgactgaaagtgctggcatttggagcaaagccggattccaccctgcatacctacttcccttctttcctgtccagagccacccctagctgtccccctgagatgaagaaagaggtgaggatatggtgggaggctttttctccttccccaggggtcagctgtagcggtccctatctgctgacaaaggccttgccttcacagagcccattctgaggcttttccttagctccctgttgacagctgcctgccccgctcactcgagcttcaccctcagaagatggatcccaagagacagcacattcaggtctgggtggtttctgatgcccgtctcttgcagatagtgatctttgagctcaaagctctagctcaggagccccagcctcctgctttacagcctctcagagagctttctggagtcttgacactttgcatccagagacactttgcatccagagacactttgcatccagagacactttgcatccagagacacttgcattccagag

SEQ ID NO: 436906 - DNA, 1231 bp, Homo sapiens
ggcgggcgccgggcgccgggcgcgcggtcctgcgaggagacgtggcagagtgcggctgcgctcgcgccggaccggaaagccggggaagtggccgaggagggagggctgcgagccatggcgaccaagacggcgggcgtggggcggtgggaggtagtgaagaagggtcggcggcctggggtcggcgccggcgccggcggccgaggaggcggcaggaaccgcagggcgctcggggaagcaaacggagtgtggaaatacgacctgacccctgcaatccagaccacaagcaccctttatgagcggggctttgagaatatcatgaagcggcagaataaggagcaggtcccaccccctgctgtggaacctaagaaaccagggaacaagaagcagccaaagaaggtggcaactcctcccaaccaaaaccagaagcagggccgcttccgcagcctggaggaagcactgaaagctctggatgtggcagacctgcagaaggaactggacaagagccagagtgtgttctctggaaacccatccatatggttgaaggacctggccagctatctcaactacaagctacaagctcctctaagtgaacccacgctgagccagcatactcatgattatccctacagcctggtgagccgggagctacgtgggatcatccgagggctgctggcgaaggcagcagggtctctggagctcttttttgaccactgtctgttcaccatgttgcaagagctggataagacaccaggggagtcactacatggttaccgcatctgtatccaggccatcctgcaagacaagcccaagattgccacggcaaacctaggcaagttcctggaactgctgaggtcccaccagagccgaccagcaaagtgtctcaccatcatgtgggccctgggtcaagcaggttttgccaacctcaccgagggactgaaagtgtggctggggatcatgctgcctgtgctgggcatcaagtctctgtctccctgtcccctcccttgtagtcctacttcttccaactttccattccccatcatgctgggggtcttggtcacaaggctcagcttctctccactgtccatccctcctatcatctgtagagcagagcacaggcagttgtgtgccttgggcccagggaaccctccatcaacctgagacaggactcagtatatggttcttgggtatgccctaccaggtggaataaaggacacagatttgatttctagca

SEQ ID NO: 436907 - DNA, 812 bp, Homo sapiens
ggcgggcgccgggcgccgggcgcgcggtcctgcgaggagacgtggcagagtgcggctgcgctcgcgccggaccggaaagccggggaagtggccgaggagggagggctgcgagccatggcgaccaagacggcgggcgtggggcggtgggaggtagtgaagaagggtcggcggcctggggtcggcgccggcgccggcggccgaggaggcggcaggaaccgcagggcgctcggggaagcaaacggagtgtggaaatacgacctgacccctgcaatccagaccacaagcaccctttatgagcggggctttgagaatatcatgaagcggcagaataaggagcaggtcccaccccctgctgtggaacctaagaaaccagggaacaagaagcagccaaagaaggtggcaactcctcccaaccaaaaccagaagcagggccgcttccgcagcctggaggaagcactgaaagctctggatgtggcagacctgcagaaggaactggacaagagccagagtgtgttctctggaaacccatccatatggttgaaggacctggccagctatctcaactacaagctacaagctcctctaagtgaacccacgctgagccagcatactcatggtaagtccttccagcttcctcaagctcagacaagttcaaataaattcaaaaagggtggtataacagatcccagtgccccacactgtcctgatttccatgggtgatttgggctggtctcaaatcatcgtgactgtgaatgtttctgggcctcattctgtgatcctccctctgggcctcctcagaggaaggatcccag

SEQ ID NO: 436908 - DNA, 507 bp, Homo sapiens
caaagtgtctcaccatcatgtgggccctgggtcaagcaggttttgccaacctcaccgagggactgaaaggtaacagggaaatagggaagaaagagggagggtctcggagctggaaaactcctctttgatgcccccagtaggtgcaagcctgaggcctccctcgtgacttttacccctgcagtgtggctggggatcatgctgcctgtgctgggcatcaagtctctgtctccctttgccatcacatacctggatcggctgctcctgtgagtaatgggagggcagcaaggggaaggctcagggtgtcccaagtggctgttatagcaaaatgggaggctatgatcttggtctccatggatatgaggaaaatcaggaccagcttctcccaccaccttagaatgtgatggtgaggaaggaagaagagggagctattaagggctggcagatggggtagagtttataccctttttcctagatgttggcttagctggggtcatggccaaaacagct

SEQ ID NO: 436909 - DNA, 3044 bp, Homo sapiens
ggcgggcgccgggcgccgggcgcgcggtcctgcgaggagacgtggcagagtgcggctgcgctcgcgccggaccggaaagccggggaagtggccgaggagggagggctgcgagccatggcgaccaagacggcgggcgtggggcggtgggaggtagtgaagaagggtcggcggcctggggtcggcgccggcgccggcggccgaggaggcggcaggaaccgcagggcgctcggggaagcaaacggagtgtggaaatacgacctgacccctgcaatccagaccacaagcaccctttatgagcggggctttgagaatatcatgaagcggcagaataaggagcaggtcccaccccctgctgtggaacctaagaaaccagggaacaagaagcagccaaagaaggtggcaactcctcccaaccaaaaccagaagcagggccgcttccgcagcctggaggaagcactgaaagctctggatgtggcagacctgcagaaggaactggacaagagccagagtgtgttctctggaaacccatccatatggttgaaggacctggccagctatctcaactacaagctacaagctcctctaagtgaacccacgctgagccagcatactcatgattatccctacagcctggtgagccgggagctacgtgggatcatccgagggctgctggcgaaggcagcagggtctctggagctcttttttgaccactgtctgttcaccatgttgcaagagctggataagacaccaggggagtcactacatggttaccgcatctgtatccaggccatcctgcaagacaagcccaagattgccacggcaaacctaggcaagttcctggaactgctgaggtcccaccagagccgaccagcaaagtgtctcaccatcatgtgggccctgggtcaagcaggttttgccaacctcaccgagggactgaaagtgtggctggggatcatgctgcctgtgctgggcatcaagtctctgtctccctttgccatcacatacctggatcggctgctcctgatgcatcccaaccttaccaagggcttcggcatgattggccccaaggacttcttcccacttctggactttgcctatatgccgaacaactccctgacacccagcctgcaggagcagctgtgtcagctctacccccgactgaaagtgctggcatttggagcaaagccggattccaccctgcatacctacttcccttctttcctgtccagagccacccctagctgtccccctgagatgaagaaagagctcctgagcagcctgactgagtgcctgacggtggaccccctcagtgccagcgtctggaggcagctgtaccctaagcacctgtcacagtccagccttctgctggagcacttgctcagctcctgggagcagattcccaagaaggtacagaagtctttgcaagaaaccattcagtccctcaagcttaccaaccaggagctgctgaggaagggtagcagtaacaaccaggatgtcgtcacctgtgacatggcctgcaagggcctgttgcagcaggttcagggtcctcggctgccctggacgcggctcctcctgttgctgctggtcttcgctgtaggcttcctgtgccatgacctccggtcacacagctccttccaggcctcccttactggccggttgcttcgatcatctggcttcttacctgctagccaacaagcgtgtgccaagctctactcctacagtctgcaaggctacagctggctgggggagacactgccgctctggggctcccacctgctcaccgtggtgcggcccagcttgcagctggcctgggctcacaccaatgccacagtcagcttcctttctgcccactgtgcctctcaccttgcgtggtttggtgacagtctcaccagtctctctcagaggctacagatccagctccccgattccgtgaatcagctactccgctatctgagagagctgcccctgcttttccaccagaatgtgctgctgccactgtggcacctcttgcttgaggccctggcctgggcccaggagcactgccatgaggcatgcagaggtgaggtgacctgggactgcatgaagacacagctcagtgaggctgtccactggacctggctttgcctacaggacattacagtggctttcttggactgggcacttgccctgatatcccagcagtaggccctgccttcctggccactgatttctgcatgggtagaccatccaagactgcagcgggtagaaggtggcagttcttcatgggagtctttttaacttggtgcctgagttctctcctaggcaagtggccagttgcctccacctcagttcttccatctttggtggggacagggcccagcagcatctcagcctcctacccacaattccactgaacacttttctggccctactgcacatggcccccagcctccatccttgtgctggtagcctctcacaactccgcccttgccctctgccttccacttccttccatctcatttctaaaccccaaacagctcatctctaaaaagatagaactcccagcaggtggcttctgtgttcttctgacaaatgattcctgcttctccagactttagcagcctcctgttcccattcttggtcacagctctagccacagcagaaggaaaggggcttccagaagaatatagcaccgcattgggaaacagcagcctcacctccacctgaagcctgggtgtggctgtcagtggacatggggagctggatggaaatgcctctcacttcaaaatgcccagcctgccccaaatgcctctaagcccctccctgtcccctcccttgtagtcctacttcttccaactttccattccccatcatgctgggggtcttggtcacaaggctcagcttctctccactgtccatccctcctatcatctgtagagcagagcacaggcagttgtgtgccttgggcccagggaaccctccatcaacctgagacaggactcagtatatggttcttgggtatgccctaccaggtggaataaaggacacagatttgatttctagca

SEQ ID NO: 436910 - DNA, 2872 bp, Homo sapiens
ccgtgcagctgaatgctgctggtcgtatctacgaggtatcccctggtagcgctcgggttaggccaacggagtgtggaaatacgaccttgacccctgcaatccagaccacaagcaccctttatgagcggggctttgagaatatcatgaagcggcagaataaggagcaggtcccaccccctgctgtggaacctaagaaaccagggaacaagaagcagccaaagaaggtggcaactcctcccaaccaaaaccagaagcagggccgcttccgcagcctggaggaagcactgaaagctctggatgtggcagacctgcagaaggaactggacaagagccagagtgtgttctctggaaacccatccatatggttgaaggacctggccagctatctcaactacaagctacaagctcctctaagtgaacccacgctgagccagcatactcatgattatccctacagcctggtgagccgggagctacgtgggatcatccgagggctgctggcgaaggcagcagggtctctggagctcttttttgaccactgtctgttcaccatgttgcaagagctggataagacaccaggggagtcactacatggttaccgcatctgtatccaggccatcctgcaagacaagcccaagattgccacggcaaacctaggcaagttcctggaactgctgaggtcccaccagagccgaccagcaaagtgtctcaccatcatgtgggccctgggtcaagcaggttttgccaacctcaccgagggactgaaagtgtggctggggatcatgctgcctgtgctgggcatcaagtctctgtctccctttgccatcacatacctggatcggctgctcctgatgcatcccaaccttaccaagggcttcggcatgattggccccaaggacttcttcccacttctggactttgcctatatgccgaacaactccctgacacccagcctgcaggagcagctgtgtcagctctacccccgactgaaagtgctggcatttggagcaaagccggattccaccctgcatacctacttcccttctttcctgtccagagccacccctagctgtccccctgagatgaagaaagagctcctgagcagcctgactgagtgcctgacggtggaccccctcagtgccagcgtctggaggcagctgtaccctaagcacctgtcacagtccagccttctgctggagcacttgctcagctcctgggagcagattcccaagaaggtacagaagtctttgcaagaaaccattcagtccctcaagcttaccaaccaggagctgctgaggaagggtagcagtaacaaccaggatgtcgtcacctgtgacatggcctgcaagggcctgttgcagcaggttcagggtcctcggctgccctggacgcggctcctcctgttgctgctggtcttcgctgtaggcttcctgtgccatgacctccggtcacacagctccttccaggcctcccttactggccggttgcttcgatcatctggcttcttacctgctagccaacaagcgtgtgccaagctctactcctacagtctgcaaggctacagctggctgggggagacactgccgctctggggctcccacctgctcaccgtggtgcggcccagcttgcagctggcctgggctcacaccaatgccacagtcagcttcctttctgcccactgtgcctctcaccttgcgtggtttggtgacagtctcaccagtctctctcagaggctacagatccagctccccgattccgtgaatcagctactccgctatctgagagagctgcccctgcttttccaccagaatgtgctgctgccactgtggcacctcttgcttgaggccctggcctgggcccaggagcactgccatgaggcatgcagaggtgaggtgacctgggactgcatgaagacacagctcagtgaggctgtccactggacctggctttgcctacaggacattacagtggctttcttggactgggcacttgccctgatatcccagcagtaggccctgccttcctggccactgatttctgcatgggtagaccatccaagactgcagcgggtagaaggtggcagttcttcatgggagtctttttaacttggtgcctgagttctctcctaggcaagtggccagttgcctccacctcagttcttccatctttggtggggacagggcccagcagcatctcagcctcctacccacaattccactgaacacttttctggccctactgcacatggcccccagcctccatccttgtgctggtagcctctcacaactccgcccttgccctctgccttccacttccttccatctcatttctaaaccccaaacagctcatctctaaaaagatagaactcccagcaggtggcttctgtgttcttctgacaaatgattcctgcttctccagactttagcagcctcctgttcccattcttggtcacagctctagccacagcagaaggaaaggggcttccagaagaatatagcaccgcattgggaaacagcagcctcacctccacctgaagcctgggtgtggctgtcagtggacatggggagctggatggaaatgcctctcacttcaaaatgcccagcctgccccaaatgcctctaagcccctccctgtcccctcccttgtagtcctacttcttccaactttccattccccatcatgctgggggtcttggtcacaaggctcagcttctctccactgtccatccctcctatcatctgtagagcagagcacaggcagttgtgtgccttgggcccagggaaccctccatcaacctgagacaggactcagtatatggttcttgggtatgccctaccaggtggaataaaggacacagatttgatttctagca

SEQ ID NO: 436911 - DNA, 2743 bp, Homo sapiens
agggagagcaccacagttctcagagctgatgggtgtctggtcctagcactcacattgaggcctatgggccttagattatccctacagcctggtgagccgggagctacgtgggatcatccgagggctgctggcgaaggcagcagggtctctggagctcttttttgaccactgtctgttcaccatgttgcaagagctggataagacaccaggtgaaaggggcacgggagggatgaccatcttgggagcctcctcctttttttcctgcttccagtaccactcagtggttctgtttccagcagagaaatgtgctaaccttaacactttttggaaagtgtggaggaagttaggagtcagtggacctggggcctgggctcaccgctgacaaatgggagatttcaggtttgggatgccaaataatgtgagtaggtgtgagaatgtgtatctctccaggggagtcactacatggttaccgcatctgtatccaggccatcctgcaagacaagcccaagattgccacggcaaacctaggcaagttcctggaactgctgaggtcccaccagagccgaccagcaaagtgtctcaccatcatgtgggccctgggtcaagcaggttttgccaacctcaccgagggactgaaagtgtggctggggatcatgctgcctgtgctgggcatcaagtctctgtctccctttgccatcacatacctggatcggctgctcctgatgcatcccaaccttaccaagggcttcggcatgattggccccaaggacttcttcccacttctggactttgcctatatgccgaacaactccctgacacccagcctgcaggagcagctgtgtcagctctacccccgactgaaagtgctggcatttggagcaaagccggattccaccctgcatacctacttcccttctttcctgtccagagccacccctagctgtccccctgagatgaagaaagagctcctgagcagcctgactgagtgcctgacggtggaccccctcagtgccagcgtctggaggcagctgtaccctaagcacctgtcacagtccagccttctgctggagcacttgctcagctcctgggagcagattcccaagaaggtacagaagtctttgcaagaaaccattcagtccctcaagcttaccaaccaggagctgctgaggaagggtagcagtaacaaccaggatgtcgtcacctgtgacatggcctgcaagggcctgttgcagcaggttcagggtcctcggctgccctggacgcggctcctcctgttgctgctggtcttcgctgtaggcttcctgtgccatgacctccggtcacacagctccttccaggcctcccttactggccggttgcttcgatcatctggcttcttacctgctagccaacaagcgtgtgccaagctctactcctacagtctgcaaggctacagctggctgggggagacactgccgctctggggctcccacctgctcaccgtggtgcggcccagcttgcagctggcctgggctcacaccaatgccacagtcagcttcctttctgcccactgtgcctctcaccttgcgtggtttggtgacagtctcaccagtctctctcagaggctacagatccagctccccgattccgtgaatcagctactccgctatctgagagagctgcccctgcttttccaccagaatgtgctgctgccactgtggcacctcttgcttgaggccctggcctgggcccaggagcactgccatgaggcatgcagaggtgaggtgacctgggactgcatgaagacacagctcagtgaggctgtccactggacctggctttgcctacaggacattacagtggctttcttggactgggcacttgccctgatatcccagcagtaggccctgccttcctggccactgatttctgcatgggtagaccatccaagactgcagcgggtagaaggtggcagttcttcatgggagtctttttaacttggtgcctgagttctctcctaggcaagtggccagttgcctccacctcagttcttccatctttggtggggacagggcccagcagcatctcagcctcctacccacaattccactgaacacttttctggccctactgcacatggcccccagcctccatccttgtgctggtagcctctcacaactccgcccttgccctctgccttccacttccttccatctcatttctaaaccccaaacagctcatctctaaaaagatagaactcccagcaggtggcttctgtgttcttctgacaaatgattcctgcttctccagactttagcagcctcctgttcccattcttggtcacagctctagccacagcagaaggaaaggggcttccagaagaatatagcaccgcattgggaaacagcagcctcacctccacctgaagcctgggtgtggctgtcagtggacatggggagctggatggaaatgcctctcacttcaaaatgcccagcctgccccaaatgcctctaagcccctccctgtcccctcccttgtagtcctacttcttccaactttccattccccatcatgctgggggtcttggtcacaaggctcagcttctctccactgtccatccctcctatcatctgtagagcagagcacaggcagttgtgtgccttgggcccagggaaccctccatcaacctgagacaggactcagtatatggttcttgggtatgccctaccaggtggaataaaggacacagatttgatttctagca

SEQ ID NO: 436912 - DNA, 3147 bp, Homo sapiens
ggcgggcgccgggcgccgggcgcgcggtcctgcgaggagacgtggcagagtgcggctgcgctcgcgccggaccggaaagccggggaagtggccgaggagggagggctgcgagccatggcgaccaagacggcgggcgtggggcggtgggaggtagtgaagaagggtcggcggcctggggtcggcgccggcgccggcggccgaggaggcggcaggaaccgcagggcgctcggggaagcaaacggagtgtggaaatacgacctgacccctgcaatccagaccacaagcaccctttatgagcggggctttgagaatatcatgaagcggcagaataaggagcaggtcccaccccctgctgtggaacctaagaaaccagggaacaagaagcagccaaagaaggtggcaactcctcccaaccaaaaccagaagcagggccgcttccgcagcctggaggaagcactgaaagctctggatgtggcagacctgcagaaggaactggacaagagccagagtgtgttctctggaaacccatccatatggttgaaggacctggccagctatctcaactacaagctacaagctcctctaagtgaacccacgctgagccagcatactcatgattatccctacagcctggtgagccgggagctacgtgggatcatccgagggctgctggcgaaggcagcagggtctctggagctcttttttgaccactgtctgttcaccatgttgcaagagctggataagacaccaggggagtcactacatggttaccgcatctgtatccaggccatcctgcaagacaagcccaagattgccacggcaaacctaggcaagttcctggaactgctgaggtcccaccagagccgaccagcaaagtgtctcaccatcatgtgggccctgggtcaagcaggttttgccaacctcaccgagggactgaaagtgtggctggggatcatgctgcctgtgctgggcatcaagtctctgtctccctttgccatcacatacctggatcggctgctcctgatgcatcccaaccttaccaagggcttcggcatgattggccccaaggacttcttcccacttctggactttgcctatatgccgaacaactccctgacacccagcctgcaggagcagctgtgtcagctctacccccgactgaaagtgctggcatttggagcaaagccggattccaccctgcatacctacttcccttctttcctgtccagagccacccctagctgtccccctgagatgaagaaagagagcccattctgaggcttttccttagctccctgttgacagctgcctgccccgctcactcgagcttcaccctcagaagatggatcccaagagacagcacattcagctcctgagcagcctgactgagtgcctgacggtggaccccctcagtgccagcgtctggaggcagctgtaccctaagcacctgtcacagtccagccttctgctggagcacttgctcagctcctgggagcagattcccaagaaggtacagaagtctttgcaagaaaccattcagtccctcaagcttaccaaccaggagctgctgaggaagggtagcagtaacaaccaggatgtcgtcacctgtgacatggcctgcaagggcctgttgcagcaggttcagggtcctcggctgccctggacgcggctcctcctgttgctgctggtcttcgctgtaggcttcctgtgccatgacctccggtcacacagctccttccaggcctcccttactggccggttgcttcgatcatctggcttcttacctgctagccaacaagcgtgtgccaagctctactcctacagtctgcaaggctacagctggctgggggagacactgccgctctggggctcccacctgctcaccgtggtgcggcccagcttgcagctggcctgggctcacaccaatgccacagtcagcttcctttctgcccactgtgcctctcaccttgcgtggtttggtgacagtctcaccagtctctctcagaggctacagatccagctccccgattccgtgaatcagctactccgctatctgagagagctgcccctgcttttccaccagaatgtgctgctgccactgtggcacctcttgcttgaggccctggcctgggcccaggagcactgccatgaggcatgcagaggtgaggtgacctgggactgcatgaagacacagctcagtgaggctgtccactggacctggctttgcctacaggacattacagtggctttcttggactgggcacttgccctgatatcccagcagtaggccctgccttcctggccactgatttctgcatgggtagaccatccaagactgcagcgggtagaaggtggcagttcttcatgggagtctttttaacttggtgcctgagttctctcctaggcaagtggccagttgcctccacctcagttcttccatctttggtggggacagggcccagcagcatctcagcctcctacccacaattccactgaacacttttctggccctactgcacatggcccccagcctccatccttgtgctggtagcctctcacaactccgcccttgccctctgccttccacttccttccatctcatttctaaaccccaaacagctcatctctaaaaagatagaactcccagcaggtggcttctgtgttcttctgacaaatgattcctgcttctccagactttagcagcctcctgttcccattcttggtcacagctctagccacagcagaaggaaaggggcttccagaagaatatagcaccgcattgggaaacagcagcctcacctccacctgaagcctgggtgtggctgtcagtggacatggggagctggatggaaatgcctctcacttcaaaatgcccagcctgccccaaatgcctctaagcccctccctgtcccctcccttgtagtcctacttcttccaactttccattccccatcatgctgggggtcttggtcacaaggctcagcttctctccactgtccatccctcctatcatctgtagagcagagcacaggcagttgtgtgccttgggcccagggaaccctccatcaacctgagacaggactcagtatatggttcttgggtatgccctaccaggtggaataaaggacacagatttgatttctagca

SEQ ID NO: 436913 - DNA, 2947 bp, Homo sapiens
ggcgggcgccgggcgccgggcgcgcggtcctgcgaggagacgtggcagagtgcggctgcgctcgcgccggaccggaaagccggggaagtggccgaggagggagggctgcgagccatggcgaccaagacggcgggcgtggggcggtgggaggtagtgaagaagggtcggcggcctggggtcggcgccggcgccggcggccgaggaggcggcaggaaccgcagggcgctcggggaagcaaacggagtgtggaaatacgacctgacccctgcaatccagaccacaagcaccctttatgagcggggctttgagaatatcatgaagcggcagaataaggagcaggtcccaccccctgctgtggaacctaagaaaccagggaacaagaagcagccaaagaaggtggcaactcctcccaaccaaaaccagaagcagggccgcttccgcagcctggaggaagcactgaaagctctggatgtggcagacctgcagaaggaactggacaagagccagagtgtgttctctggaaacccatccatatggttgaaggacctggccagctatctcaactacaagctacaagctcctctaagtgaacccacgctgagccagcatactcatgattatccctacagcctggtgagccgggagctacgtgggatcatccgagggctgctggcgaaggcagcagggtctctggagctcttttttgaccactgtctgttcaccatgttgcaagagctggataagacaccaggggagtcactacatggttaccgcatctgtatccaggccatcctgcaagacaagcccaagattgccacggcaaacctaggcaagttcctggaactgctgaggtcccaccagagccgaccagcaaagtgtctcaccatcatgtgggccctgggtcaagcaggttttgccaacctcaccgagggactgaaagtgtggctggggatcatgctgcctgtgctgggcatcaagtctctgtctccctttgccatcacatacctggatcggctgctcctgatgcatcccaaccttaccaagggcttcggcatgattggccccaaggacttcttcccacttctggactttgcctatatgccgaacaactccctgacacccagcctgcaggagcagctgtgtcagctctacccccgactgaaagtgctggcatttggagcaaagccggattccaccctgcatacctacttcccttctttcctgtccagagccacccctagctgtccccctgagatgaagaaagagctcctgagcagcctgactgagtgcctgacggtggaccccctcagtgccagcgtctggaggcagctgtaccctaagcacctgtcacagtccagccttctgctggagcacttgctcagctcctgggagcagattcccaagaaggtacagaagtctttgcaagaaaccattcagtccctcaagcttaccaaccaggagctgctgaggaagggtagcagtaacaaccaggatgtcgtcacctgtgacatggcctgcaagggcctgttgcagcaggttcagggtcctcggctgccctggacgcggctcctcctgttgctgctggtcttcgctgtaggcttcctgtgccatgacctccggtcacacagctccttccaggctggctgggggagacactgccgctctggggctcccacctgctcaccgtggtgcggcccagcttgcagctggcctgggctcacaccaatgccacagtcagcttcctttctgcccactgtgcctctcaccttgcgtggtttggtgacagtctcaccagtctctctcagaggctacagatccagctccccgattccgtgaatcagctactccgctatctgagagagctgcccctgcttttccaccagaatgtgctgctgccactgtggcacctcttgcttgaggccctggcctgggcccaggagcactgccatgaggcatgcagaggtgaggtgacctgggactgcatgaagacacagctcagtgaggctgtccactggacctggctttgcctacaggacattacagtggctttcttggactgggcacttgccctgatatcccagcagtaggccctgccttcctggccactgatttctgcatgggtagaccatccaagactgcagcgggtagaaggtggcagttcttcatgggagtctttttaacttggtgcctgagttctctcctaggcaagtggccagttgcctccacctcagttcttccatctttggtggggacagggcccagcagcatctcagcctcctacccacaattccactgaacacttttctggccctactgcacatggcccccagcctccatccttgtgctggtagcctctcacaactccgcccttgccctctgccttccacttccttccatctcatttctaaaccccaaacagctcatctctaaaaagatagaactcccagcaggtggcttctgtgttcttctgacaaatgattcctgcttctccagactttagcagcctcctgttcccattcttggtcacagctctagccacagcagaaggaaaggggcttccagaagaatatagcaccgcattgggaaacagcagcctcacctccacctgaagcctgggtgtggctgtcagtggacatggggagctggatggaaatgcctctcacttcaaaatgcccagcctgccccaaatgcctctaagcccctccctgtcccctcccttgtagtcctacttcttccaactttccattccccatcatgctgggggtcttggtcacaaggctcagcttctctccactgtccatccctcctatcatctgtagagcagagcacaggcagttgtgtgccttgggcccagggaaccctccatcaacctgagacaggactcagtatatggttcttgggtatgccctaccaggtggaataaaggacacagatttgatttctagca

SEQ ID NO: 436914 - DNA, 1442 bp, Homo sapiens
ggcgggcgccgggcgccgggcgcgcggtcctgcgaggagacgtggcagagtgcggctgcgctcgcgccggaccggaaagccggggaagtggccgaggagggagggctgcgagccatggcgaccaagacggcgggcgtggggcggtgggaggtagtgaagaagggtcggcggcctggggtcggcgccggcgccggcggccgaggaggcggcaggaaccgcagggcgctcggggaagcaaacggagtgtggaaatacgacctgacccctgcaatccagaccacaagcaccctttatgagcggggctttgagaatatcatgaagcggcagaataaggagcaggtcccaccccctgctgtggaacctaagaaaccagggaacaagaagcagccaaagaaggtggcaactcctcccaaccaaaaccagaagcagggccgcttccgcagcctggaggaagcactgaaagctctggatgtggcagacctgcagaaggaactggacaagagccagagtgtgttctctggaaacccatccatatggttgaaggacctggccagctatctcaactacaagctacaagctcctctaagtgaacccacgctgagccagcatactcatgattatccctacagcctggtgagccgggagctacgtgggatcatccgagggctgctggcgaaggcagcagggtctctggagctcttttttgaccactgtctgttcaccatgttgcaagagctggataagacaccaggggagtcactacatggttaccgcatctgtatccaggccatcctgcaagacaagcccaagattgccacggcaaacctaggcaagttcctggaactgctgaggtcccaccagagccgaccagcaaagtgtctcaccatcatgtgggccctgggtcaagcaggttttgccaacctcaccgagggactgaaagtgtggctggggatcatgctgcctgtgctgggcatcaagtctctgtctccctttgccatcacatacctggatcggctgctcctgatgcatcccaaccttaccaagggcttcggcatgattggccccaaggacttcttcccacttctggactttgcctatatgccgaacaactccctgacacccagcctgcaggagcagctgtgtcagctctacccccgactgaaagtgctggcatttggagcaaagccggattccaccctgcatacctacttcccttctttcctgtccagagccacccctagctgtccccctgagatgaagaaagagctcctgagcagcctgactgagtgcctgacggtggaccccctcagtgccagcgtctggaggcagctgtaccctaagcacctgtcacagtccagccttctgctggagcacttgctcagctcctgggagcagattcccaagaaggtgaggagctgggaggacgtggcaggttgagccct

SEQ ID NO: 436915 - DNA, 1288 bp, Homo sapiens
ggcgggcgccgggcgccgggcgcgcggtcctgcgaggagacgtggcagagtgcggctgcgctcgcgccggaccggaaagccggggaagtggccgaggagggagggctgcgagccatggcgaccaagacggcgggcgtggggcggtgggaggtagtgaagaagggtcggcggcctggggtcggcgccggcgccggcggccgaggaggcggcaggaaccgcagggcgctcggggaagcaaacggagtgtggaaatacgacctgacccctgcaatccagaccacaagcaccctttatgagcggggctttgagaatatcatgaagcggcagaataaggagcaggtcccaccccctgctgtggaacctaagaaaccagggaacaagaagcagccaaagaaggtggcaactcctcccaaccaaaaccagaagcagggccgcttccgcagcctggaggaagcactgaaagctctggatgtggcagacctgcagaaggaactggacaagagccagagtgtgttctctggaaacccatccatatggttgaaggacctggccagctatctcaactacaagctacaagctcctctaagtgaacccacgctgagccagcatactcatgattatccctacagcctggtgagccgggagctacgtgggatcatccgagggctgctggcgaaggcagcagggtctctggagctcttttttgaccactgtctgttcaccatgttgcaagagctggataagacaccaggggagtcactacatggttaccgcatctgtatccaggccatcctgcaagacaagcccaagattgccacggcaaacctaggcaagttcctggaactgctgaggtcccaccagagccgaccagcaaagtgtctcaccatcatgtgggccctgggtcaagcaggttttgccaacctcaccgagggactgaaagtgtggctggggatcatgctgcctgtgctgggcatcaagtctctgtctccctttgccatcacatacctggatcggctgctcctgatgcatcccaaccttaccaagggcttcggcatgattggccccaaggattcttccaactttccattccccatcatgctgggggtcttggtcacaaggctcagcttctctccactgtccatccctcctatcatctgtagagcagagcacaggcagttgtgtgccttgggcccagggaaccctccatcaacctgagacaggactcagtatatggttcttgggtatgccctaccaggtggaataaaggacacagatttgatttctagca

SEQ ID NO: 436916 - DNA, 844 bp, Homo sapiens
ggcgggcgccgggcgccgggcgcgcggtcctgcgaggagacgtggcagagtgcggctgcgctcgcgccggaccggaaagccggggaagtggccgaggagggagggctgcgagccatggcgaccaagacggcgggcgtggggcggtgggaggtagtgaagaagggtcggcggcctggggtcggcgccggcgccggcggccgaggaggcggcaggaaccgcagggcgctcggggaagcaaacggagtgtggaaatacgacctgacccctgcaatccagaccacaagcaccctttatgagcggggctttgagaatatcatgaagcggcagaataaggagcaggtcccaccccctgctgtggaacctaagaaaccagggaacaagaagcagccaaagaaggtggcaactcctcccaaccaaaaccagaagcagggccgcttccgcagcctggaggaagcactgaaagctctggatgtggcagacctgcagaaggaactggacaagagccagagtgtgttctctggaaacccatccatatggttgaaggacctggccagctatctcaactacaagctacaagctcctctaagtgaacccacgctgagccagcatactcatgattatccctacagcctggtgagccgggagctacgtgggatcatccgagggctgctggcgaaggcagcagggtctctggagctcttttttgaccactgtctgttcaccatgttgcaagagctggataagacaccagggaaccctccatcaacctgagacaggactcagtatatggttcttgggtatgccctaccaggtggaataaaggacacagatttgatttctagca

SEQ ID NO: 436917 - DNA, 2332 bp, Homo sapiens
ggcaggtcccggccgccgggaggaagtggccgggcggtcgcaggactccggggcgaccgccgcgagtccgcagtagttcgggccatggaggcggagccgccgctctacccgatggcgggggctgcggggccgcagggcgacgaggacctgctcggggtcccggacgggcccgaggccccgctggacgagctggtgggcgcgtaccccaactacaacgaggaggaggaggagcgccgctactaccgccgcaagcgcctgggcgtgctcaagaacgtgctggctgccagcgccgggggcatgctcacctacggcgtctacctgggcctcctgcagatgcagctgatcctgcactacgacgagacctaccgcgaggtgaagtatggcaacatggggctgcccgacatcgacagcaaaatgctgatgggcatcaacgtgactcccatcgccgccctgctctacacacctgtgctcatcaggttttttggaacgaagtggatgatgttcctcgctgtgggcatctacgccctctttgtctccaccaactactgggagcgctactacacgcttgtgccctcggctgtggccctgggcatggccatcgtgcctctttgggcttccatgggcaactacatcaccaggatggcgcagaagtaccatgagtactcccactacaaggagcaggatgggcaggggatgaagcagcggcctccgcggggctcccacgcgccctatctcctggtcttccaagccatcttctacagcttcttccatctgagcttcgcctgcgcccagctgcccatgatttatttcctgaaccactacctgtatgacctgaaccacacgctgtacaatgtgcagagctgcggcaccaacagccacgggatcctcagcggcttcaacaagacggttctgcggacgctcccgcggagcggaaacctcattgtggtggagagcgtgctcatggcagtggccttcctggccatgctgctggtgctgggtttgtgcggagccgcttaccggcccacggaggagatcgatctgcgcagcgtgggctggggcaacatcttccagctgcccttcaagcacgtgcgtgactaccgcctgcgccacctcgtgcctttctttatctacagcggcttcgaggtgctctttgcctgcactggtatcgccttgggctatggcgtgtgctcggtggggctggagcggctggcttacctcctcgtggcttacagcctgggcgcctcagccgcctcactcctgggcctgctgggcctgtggctgccacgcccggtgcccctggtggccggagcaggggtgcacctgctgctcaccttcatcctctttttctgggcccctgtgcctcgggtcctgcaacacagctggatcctctatgtggcagctgccctttggggtgtgggcagtgccctgaacaagactggactcagcacactcctgggaatcttgtacgaagacaaggagagacaggacttcatcttcaccatctaccactggtggcaggctgtggccatcttcaccgtgtacctgggctcgagcctgcacatgaaggctaagctggcggtgctgctggtgacgctggtggcggccgcggtctcctacctgcggatggagcagaagctgcgccggggcgtggccccgcgccagccccgcatcccgcggccccagcacaaggtgcgcggttaccgctacttggaggaggacaactcggacgagagcgacgcggagggcgagcatggggacggcgcggaggaggaggcgccgcccgcagggcccaggcctggccccgagcccgctggactcggccgccggccctgcccgtacgaacaggcgcaggggggagacgggccggaggagcagtgaggggccgcctggtccccggactcagcctccctcctcgccggcctcagtttaccacgtctgaggtcggggggaccccctccgagtcccgcgctgtcttcaaaggcccctgtctcccctcccccacgttggggacgcccctcccagagcccaggtcacctccgggcttccgcagccccctccaaggcggagtggagccttgggaacccctcggccaagcacaggggttcgaaaatacagctgaaaccccgcgggcccttagcacgcgccccagcgccggagcacggtcagggtcttcttgcgacccggcccgctccagatccccacagctctcggccgcggacccgggccgcgtgtgagcgcactttgcacctcctatccccagggtccgccgagagccacgattttttacagaaaatgagcaataaagagattttgtactgtcaaaaacctcgtg

SEQ ID NO: 436918 - DNA, 2422 bp, Homo sapiens
ggctggtacgcctgggatttgggatcatggaggcggagccgccgctctacccgatggcgggggctgcggggccgcagggcgacgaggacctgctcggggtcccggacgggcccgaggccccggtgagcggggacccggagtgcgaggcgcgggcgtcccctgtgggccaggtccccccggcgggggcggggcgggccggggggcggcgggcaccgggggacacgggttcggggcgcgatcgcgggtgcgagcggcgtgcgtggctcgcagctggacgagctggtgggcgcgtaccccaactacaacgaggaggaggaggagcgccgctactaccgccgcaagcgcctgggcgtgctcaagaacgtgctggctgccagcgccgggggcatgctcacctacggcgtctacctgggcctcctgcagatgcagctgatcctgcactacgacgagacctaccgcgaggtgaagtatggcaacatggggctgcccgacatcgacagcaaaatgctgatgggcatcaacgtgactcccatcgccgccctgctctacacacctgtgctcatcaggttttttggaacgaagtggatgatgttcctcgctgtgggcatctacgccctctttgtctccaccaactactgggagcgctactacacgcttgtgccctcggctgtggccctgggcatggccatcgtgcctctttgggcttccatgggcaactacatcaccaggatggcgcagaagtaccatgagtactcccactacaaggagcaggatgggcaggggatgaagcagcggcctccgcggggctcccacgcgccctatctcctggtcttccaagccatcttctacagcttcttccatctgagcttcgcctgcgcccagctgcccatgatttatttcctgaaccactacctgtatgacctgaaccacacgctgtacaatgtgcagagctgcggcaccaacagccacgggatcctcagcggcttcaacaagacggttctgcggacgctcccgcggagcggaaacctcattgtggtggagagcgtgctcatggcagtggccttcctggccatgctgctggtgctgggtttgtgcggagccgcttaccggcccacggaggagatcgatctgcgcagcgtgggctggggcaacatcttccagctgcccttcaagcacgtgcgtgactaccgcctgcgccacctcgtgcctttctttatctacagcggcttcgaggtgctctttgcctgcactggtatcgccttgggctatggcgtgtgctcggtggggctggagcggctggcttacctcctcgtggcttacagcctgggcgcctcagccgcctcactcctgggcctgctgggcctgtggctgccacgcccggtgcccctggtggccggagcaggggtgcacctgctgctcaccttcatcctctttttctgggcccctgtgcctcgggtcctgcaacacagctggatcctctatgtggcagctgccctttggggtgtgggcagtgccctgaacaagactggactcagcacactcctgggaatcttgtacgaagacaaggagagacaggacttcatcttcaccatctaccactggtggcaggctgtggccatcttcaccgtgtacctgggctcgagcctgcacatgaaggctaagctggcggtgctgctggtgacgctggtggcggccgcggtctcctacctgcggatggagcagaagctgcgccggggcgtggccccgcgccagccccgcatcccgcggccccagcacaaggtgcgcggttaccgctacttggaggaggacaactcggacgagagcgacgcggagggcgagcatggggacggcgcggaggaggaggcgccgcccgcagggcccaggcctggccccgagcccgctggactcggccgccggccctgcccgtacgaacaggcgcaggggggagacgggccggaggagcagtgaggggccgcctggtccccggactcagcctccctcctcgccggcctcagtttaccacgtctgaggtcggggggaccccctccgagtcccgcgctgtcttcaaaggcccctgtctcccctcccccacgttggggacgcccctcccagagcccaggtcacctccgggcttccgcagccccctccaaggcggagtggagccttgggaacccctcggccaagcacaggggttcgaaaatacagctgaaaccccgcgggcccttagcacgcgccccagcgccggagcacggtcagggtcttcttgcgacccggcccgctccagatccccacagctctcggccgcggacccgggccgcgtgtgagcgcactttgcacctcctatccccagggtccgccgagagccacgattttttacagaaaatgagcaataaagagattttgtactgtcaaaaacctcgtg

SEQ ID NO: 436919 - DNA, 2305 bp, Homo sapiens
ccagagcctcggtgtgggtgggggacgggggtcctgggctcccggacagacctgccaccgtcagaattggaggccggcggagcaaggcgggtgggggtctgggcttagctggccaagtggccgcgggctggcagaaggcgtggcgcagcccgggaaccccgctgtcctgaggggcgctgtcagcgggaatgccttcggtgattggagctccctgcgaggcctgcatgccgtcttctgctcggtggcgcccaaagctaggctgctccctgcacgccgctctctgtcctgtccccaggcctcctgcagatgcagctgatcctgcactacgacgagacctaccgcgaggtgaagtatggcaacatggggctgcccgacatcgacagcaaaatgctgatgggcatcaacgtgactcccatcgccgccctgctctacacacctgtgctcatcaggttttttggaacgaagtggatgatgttcctcgctgtgggcatctacgccctctttgtctccaccaactactgggagcgctactacacgcttgtgccctcggctgtggccctgggcatggccatcgtgcctctttgggcttccatgggcaactacatcaccaggatggcgcagaagtaccatgagtactcccactacaaggagcaggatgggcaggggatgaagcagcggcctccgcggggctcccacgcgccctatctcctggtcttccaagccatcttctacagcttcttccatctgagcttcgcctgcgcccagctgcccatgatttatttcctgaaccactacctgtatgacctgaaccacacgctgtacaatgtgcagagctgcggcaccaacagccacgggatcctcagcggcttcaacaagacggttctgcggacgctcccgcggagcggaaacctcattgtggtggagagcgtgctcatggcagtggccttcctggccatgctgctggtgctgggtttgtgcggagccgcttaccggcccacggaggagatcgatctgcgcagcgtgggctggggcaacatcttccagctgcccttcaagcacgtgcgtgactaccgcctgcgccacctcgtgcctttctttatctacagcggcttcgaggtgctctttgcctgcactggtatcgccttgggctatggcgtgtgctcggtggggctggagcggctggcttacctcctcgtggcttacagcctgggcgcctcagccgcctcactcctgggcctgctgggcctgtggctgccacgcccggtgcccctggtggccggagcaggggtgcacctgctgctcaccttcatcctctttttctgggcccctgtgcctcgggtcctgcaacacagctggatcctctatgtggcagctgccctttggggtgtgggcagtgccctgaacaagactggactcagcacactcctgggaatcttgtacgaagacaaggagagacaggacttcatcttcaccatctaccactggtggcaggctgtggccatcttcaccgtgtacctgggctcgagcctgcacatgaaggctaagctggcggtgctgctggtgacgctggtggcggccgcggtctcctacctgcggatggagcagaagctgcgccggggcgtggccccgcgccagccccgcatcccgcggccccagcacaaggtgcgcggttaccgctacttggaggaggacaactcggacgagagcgacgcggagggcgagcatggggacggcgcggaggaggaggcgccgcccgcagggcccaggcctggccccgagcccgctggactcggccgccggccctgcccgtacgaacaggcgcaggggggagacgggccggaggagcagtgaggggccgcctggtccccggactcagcctccctcctcgccggcctcagtttaccacgtctgaggtcggggggaccccctccgagtcccgcgctgtcttcaaaggcccctgtctcccctcccccacgttggggacgcccctcccagagcccaggtcacctccgggcttccgcagccccctccaaggcggagtggagccttgggaacccctcggccaagcacaggggttcgaaaatacagctgaaaccccgcgggcccttagcacgcgccccagcgccggagcacggtcagggtcttcttgcgacccggcccgctccagatccccacagctctcggccgcggacccgggccgcgtgtgagcgcactttgcacctcctatccccagggtccgccgagagccacgattttttacagaaaatgagcaataaagagattttgtactgtcaaaaacctcgtg

SEQ ID NO: 436920 - DNA, 2061 bp, Homo sapiens
agtgtagggcataggagacagtgccgatctatgagcgtctaactgaggctctcatttcagtatatcattgtatattgctagtagctgagacctaccgcgaggtgaagtatggcaacatggggctgcccgacatcgacagcaaaatgctgatgggcatcaacgtgactcccatcgccgccctgctctacacacctgtgctcatcaggttttttggaacgaagtggatgatgttcctcgctgtgggcatctacgccctctttgtctccaccaactactgggagcgctactacacgcttgtgccctcggctgtggccctgggcatggccatcgtgcctctttgggcttccatgggcaactacatcaccaggatggcgcagaagtaccatgagtactcccactacaaggagcaggatgggcaggggatgaagcagcggcctccgcggggctcccacgcgccctatctcctggtcttccaagccatcttctacagcttcttccatctgagcttcgcctgcgcccagctgcccatgatttatttcctgaaccactacctgtatgacctgaaccacacgctgtacaatgtgcagagctgcggcaccaacagccacgggatcctcagcggcttcaacaagacggttctgcggacgctcccgcggagcggaaacctcattgtggtggagagcgtgctcatggcagtggccttcctggccatgctgctggtgctgggtttgtgcggagccgcttaccggcccacggaggagatcgatctgcgcagcgtgggctggggcaacatcttccagctgcccttcaagcacgtgcgtgactaccgcctgcgccacctcgtgcctttctttatctacagcggcttcgaggtgctctttgcctgcactggtatcgccttgggctatggcgtgtgctcggtggggctggagcggctggcttacctcctcgtggcttacagcctgggcgcctcagccgcctcactcctgggcctgctgggcctgtggctgccacgcccggtgcccctggtggccggagcaggggtgcacctgctgctcaccttcatcctctttttctgggcccctgtgcctcgggtcctgcaacacagctggatcctctatgtggcagctgccctttggggtgtgggcagtgccctgaacaagactggactcagcacactcctgggaatcttgtacgaagacaaggagagacaggacttcatcttcaccatctaccactggtggcaggctgtggccatcttcaccgtgtacctgggctcgagcctgcacatgaaggctaagctggcggtgctgctggtgacgctggtggcggccgcggtctcctacctgcggatggagcagaagctgcgccggggcgtggccccgcgccagccccgcatcccgcggccccagcacaaggtgcgcggttaccgctacttggaggaggacaactcggacgagagcgacgcggagggcgagcatggggacggcgcggaggaggaggcgccgcccgcagggcccaggcctggccccgagcccgctggactcggccgccggccctgcccgtacgaacaggcgcaggggggagacgggccggaggagcagtgaggggccgcctggtccccggactcagcctccctcctcgccggcctcagtttaccacgtctgaggtcggggggaccccctccgagtcccgcgctgtcttcaaaggcccctgtctcccctcccccacgttggggacgcccctcccagagcccaggtcacctccgggcttccgcagccccctccaaggcggagtggagccttgggaacccctcggccaagcacaggggttcgaaaatacagctgaaaccccgcgggcccttagcacgcgccccagcgccggagcacggtcagggtcttcttgcgacccggcccgctccagatccccacagctctcggccgcggacccgggccgcgtgtgagcgcactttgcacctcctatccccagggtccgccgagagccacgattttttacagaaaatgagcaataaagagattttgtactgtcaaaaacctcgtg

SEQ ID NO: 436921 - DNA, 2402 bp, Homo sapiens
ggcaggtcccggccgccgggaggaagtggccgggcggtcgcaggactccggggcgaccgccgcgagtccgcagtagttcgggccatggaggcggagccgccgctctacccgatggcgggggctgcggggccgcagggcgacgaggacctgctcggggtcccggacgggcccgaggccccgctggacgagctggtgggcgcgtaccccaactacaacgaggaggaggaggagcgccgctactaccgccgcaagcgcctgggcgtgctcaagaacgtgctggctgccagcgccgggggcatgctcacctacggcgtctacctgggcctcctgcagatgcagctgatcctgcactacgacgagacctaccgcgaggtgaagtatggcaacatggggctgcccgacatcgacagcaaaatgctgatgggcatcaacgtgactcccatcgccgccctgctctacacacctgtgctcatcaggttttttggaacgaagtggatgatgttcctcgctgtgggcatctacgccctctttgtctccaccaactactgggagcgctactacacgcttgtgccctcggctgtggccctgggcatggccatcgtgcctctttgggcttccatgggcaactacatcaccagctctgggtgcaggacacacaggagtggcacaggtcgggctggggagagccttctctcctttgtggtccaggatggcgcagaagtaccatgagtactcccactacaaggagcaggatgggcaggggatgaagcagcggcctccgcggggctcccacgcgccctatctcctggtcttccaagccatcttctacagcttcttccatctgagcttcgcctgcgcccagctgcccatgatttatttcctgaaccactacctgtatgacctgaaccacacgctgtacaatgtgcagagctgcggcaccaacagccacgggatcctcagcggcttcaacaagacggttctgcggacgctcccgcggagcggaaacctcattgtggtggagagcgtgctcatggcagtggccttcctggccatgctgctggtgctgggtttgtgcggagccgcttaccggcccacggaggagatcgatctgcgcagcgtgggctggggcaacatcttccagctgcccttcaagcacgtgcgtgactaccgcctgcgccacctcgtgcctttctttatctacagcggcttcgaggtgctctttgcctgcactggtatcgccttgggctatggcgtgtgctcggtggggctggagcggctggcttacctcctcgtggcttacagcctgggcgcctcagccgcctcactcctgggcctgctgggcctgtggctgccacgcccggtgcccctggtggccggagcaggggtgcacctgctgctcaccttcatcctctttttctgggcccctgtgcctcgggtcctgcaacacagctggatcctctatgtggcagctgccctttggggtgtgggcagtgccctgaacaagactggactcagcacactcctgggaatcttgtacgaagacaaggagagacaggacttcatcttcaccatctaccactggtggcaggctgtggccatcttcaccgtgtacctgggctcgagcctgcacatgaaggctaagctggcggtgctgctggtgacgctggtggcggccgcggtctcctacctgcggatggagcagaagctgcgccggggcgtggccccgcgccagccccgcatcccgcggccccagcacaaggtgcgcggttaccgctacttggaggaggacaactcggacgagagcgacgcggagggcgagcatggggacggcgcggaggaggaggcgccgcccgcagggcccaggcctggccccgagcccgctggactcggccgccggccctgcccgtacgaacaggcgcaggggggagacgggccggaggagcagtgaggggccgcctggtccccggactcagcctccctcctcgccggcctcagtttaccacgtctgaggtcggggggaccccctccgagtcccgcgctgtcttcaaaggcccctgtctcccctcccccacgttggggacgcccctcccagagcccaggtcacctccgggcttccgcagccccctccaaggcggagtggagccttgggaacccctcggccaagcacaggggttcgaaaatacagctgaaaccccgcgggcccttagcacgcgccccagcgccggagcacggtcagggtcttcttgcgacccggcccgctccagatccccacagctctcggccgcggacccgggccgcgtgtgagcgcactttgcacctcctatccccagggtccgccgagagccacgattttttacagaaaatgagcaataaagagattttgtactgtcaaaaacctcgtg

SEQ ID NO: 436922 - DNA, 1335 bp, Homo sapiens
ggctggtacaggtcggagattttaggatggaggagatcgatctgcgcagcgtgggctggggcaacatcttccagctgcccttcaagcacgtgcgtgactaccgcctgcgccacctcgtgcctttctttatctacagcggcttcgaggtgctctttgcctgcactggtatcgccttgggctatggcgtgtgctcggtggggctggagcggctggcttacctcctcgtggcttacagcctgggcgcctcagccgcctcactcctgggcctgctgggcctgtggctgccacgcccggtgcccctggtggccggagcaggggtgcacctgctgctcaccttcatcctctttttctgggcccctgtgcctcgggtcctgcaacacagctggatcctctatgtggcagctgccctttggggtgtgggcagtgccctgaacaagactggactcagcacactcctgggaatcttgtacgaagacaaggagagacaggacttcatcttcaccatctaccactggtggcaggctgtggccatcttcaccgtgtacctgggctcgagcctgcacatgaaggctaagctggcggtgctgctggtgacgctggtggcggccgcggtctcctacctgcggatggagcagaagctgcgccggggcgtggccccgcgccagccccgcatcccgcggccccagcacaaggtgcgcggttaccgctacttggaggaggacaactcggacgagagcgacgcggagggcgagcatggggacggcgcggaggaggaggcgccgcccgcagggcccaggcctggccccgagcccgctggactcggccgccggccctgcccgtacgaacaggcgcaggggggagacgggccggaggagcagtgaggggccgcctggtccccggactcagcctccctcctcgccggcctcagtttaccacgtctgaggtcggggggaccccctccgagtcccgcgctgtcttcaaaggcccctgtctcccctcccccacgttggggacgcccctcccagagcccaggtcacctccgggcttccgcagccccctccaaggcggagtggagccttgggaacccctcggccaagcacaggggttcgaaaatacagctgaaaccccgcgggcccttagcacgcgccccagcgccggagcacggtcagggtcttcttgcgacccggcccgctccagatccccacagctctcggccgcggacccgggccgcgtgtgagcgcactttgcacctcctatccccagggtccgccgagagccacgattttttacagaaaatgagcaataaagagattttgtactgtcaaaaacctcgtg

SEQ ID NO: 436923 - DNA, 1237 bp, Homo sapiens
cccccgcgatgcggggagggctgagactgtggtctgggctgttccagacttcaacactcaccccttgtccccccgcagggctatggcgtgtgctcggtggggctggagcggctggcttacctcctcgtggcttacagcctgggcgcctcagccgcctcactcctgggcctgctgggcctgtggctgccacgcccggtgcccctggtggccggagcaggggtgcacctgctgctcaccttcatcctctttttctgggcccctgtgcctcgggtcctgcaacacagctggatcctctatgtggcagctgccctttggggtgtgggcagtgccctgaacaagactggactcagcacactcctgggaatcttgtacgaagacaaggagagacaggacttcatcttcaccatctaccactggtggcaggctgtggccatcttcaccgtgtacctgggctcgagcctgcacatgaaggctaagctggcggtgctgctggtgacgctggtggcggccgcggtctcctacctgcggatggagcagaagctgcgccggggcgtggccccgcgccagccccgcatcccgcggccccagcacaaggtgcgcggttaccgctacttggaggaggacaactcggacgagagcgacgcggagggcgagcatggggacggcgcggaggaggaggcgccgcccgcagggcccaggcctggccccgagcccgctggactcggccgccggccctgcccgtacgaacaggcgcaggggggagacgggccggaggagcagtgaggggccgcctggtccccggactcagcctccctcctcgccggcctcagtttaccacgtctgaggtcggggggaccccctccgagtcccgcgctgtcttcaaaggcccctgtctcccctcccccacgttggggacgcccctcccagagcccaggtcacctccgggcttccgcagccccctccaaggcggagtggagccttgggaacccctcggccaagcacaggggttcgaaaatacagctgaaaccccgcgggcccttagcacgcgccccagcgccggagcacggtcagggtcttcttgcgacccggcccgctccagatccccacagctctcggccgcggacccgggccgcgtgtgagcgcactttgcacctcctatccccagggtccgccgagagccacgattttttacagaaaatgagcaataaagagattttgtactgtcaaaaacctcgtg

SEQ ID NO: 436924 - DNA, 1597 bp, Homo sapiens
ggcaggtcccggccgccgggaggaagtggccgggcggtcgcaggactccggggcgaccgccgcgagtccgcagtagttcgggccatggaggcggagccgccgctctacccgatggcgggggctgcggggccgcagggcgacgaggacctgctcggggtcccggacgggcccgaggccccgctggacgagctggtgggcgcgtaccccaactacaacgaggaggaggaggagcgccgctactaccgccgcaagcgcctgggcgtgctcaagaacgtgctggctgccagcgccgggggcatgctcacctacggcgtctacctgggcctcctgcagatgcagctgatcctgcactacgacgagacctaccgcgaggtgaagtatggcaacatggggctgcccgacatcgacagcaaaatgctgatgggcatcaacgtgactcccatcgccgccctgctctacacacctgtgctcatcaggttttttggaacgaagtggatgatgttcctcgctgtgggcatctacgccctctttgtctccaccaactactgggagcgctactacacgcttgtgccctcggctgtggccctgggcatggccatcgtgcctctttgggcttccatgggcaactacatcaccaggatggcgcagaagtaccatgagtactcccactacaaggagcaggatgggcaggggatgaagcagcggcctccgcggggctcccacgcgccctatctcctggtcttccaagccatcttctacagcttcttccatctgagcttcgcctgcgcccagctgcccatgatttatttcctgaaccactacctgtatgacctgaaccacacgctgtacaatgtgcagagctgcggcaccaacagccacgggatcctcagcggcttcaacaagacggttctgcggacgctcccgcggagcggaaacctcattgtggtggagagcgtgctcatggcagtggccttcctggccatgctgctggtgctgggtttgtgcggagccgcttaccggcccacggaggagatcgatctgcgcagcgtgggctggggcaacatcttccagctgcccttcaagcacgtgcgtgactaccgcctgcgccacctcgtgcctttctttatctacagcggcttcgaggtgctctttgcctgcactggtatcgccttggtaagtacagcctgcaaaggattgcccgacaaaagacaagatagccaggtaaatttgaattcaagtaaacaaagaataatttttaattacatatgtaagtgtgtacatgtatatcccaaatatccccctcctgctttctcttccctctcttacccccgtcccccctttaccttgggcaagttattttaacttctctgaatcgaaatgggatagcacccacagagtgtttagttccttgtggggtacagcccacggtgtctagggacattccaagcattttcacacctgccctcagaaccttcccctgagccttggagcgaggtcaggcagtccagggagggcagggtgtggcctaaggaacacctcttgtggggagtaagagccagcccttctccccacctggctcttactccccgtatcgcgg

SEQ ID NO: 436925 - DNA, 1261 bp, Homo sapiens
ggcaggtcccggccgccgggaggaagtggccgggcggtcgcaggactccggggcgaccgccgcgagtccgcagtagttcgggccatggaggcggagccgccgctctacccgatggcgggggctgcggggccgcagggcgacgaggacctgctcggggtcccggacgggcccgaggccccgctggacgagctggtgggcgcgtaccccaactacaacgaggaggaggaggagcgccgctactaccgccgcaagcgcctgggcgtgctcaagaacgtgctggctgccagcgccgggggcatgctcacctacggcgtctacctgggcctcctgcagatgcagctgatcctgcactacgacgagacctaccgcgaggtgaagtatggcaacatggggctgcccgacatcgacagcaaaatgctgatgggcatcaacgtgactcccatcgccgccctgctctacacacctgtgctcatcaggttttttggaacgaagtggatgatgttcctcgctgtgggcatctacgccctctttgtctccaccaactactgggagcgctactacacgcttgtgccctcggctgtggccctgggcatggccatcgtgcctctttgggcttccatgggcaactacatcaccaggatggcgcagaagtaccatgagtactcccactacaaggagcaggatgggcaggggatgaagcagcggcctccgcggggctcccacgcgccctatctcctggtcttccaagccatcttctacagcttcttccatctgagcttcgcctgcgcccagctgcccatgatttatttcctgaaccactacctgtatgacctgaaccacacgctgtacaatgtgcagagctgcggcaccaacagccacgggatcctcagcggcttcaacaagacggttctgcggacgctcccgcggagcggaaacctcattgtggtggagagcgtgctcatggcagtggccttcctggccatgctgctggcggagtggagccttgggaacccctcggccaagcacaggggttcgaaaatacagctgaaaccccgcgggcccttagcacgcgccccagcgccggagcacggtcagggtcttcttgcgacccggcccgctccagatccccacagctctcggccgcggacccgggccgcgtgtgagcgcactttgcacctcctatccccagggtccgccgagagccacgattttttacagaaaatgagcaataaagagattttgtactgtcaaaaacctcgtg

SEQ ID NO: 436926 - DNA, 2282 bp, Homo sapiens
tcaggctggtactggtcccgagatttttggattcatggaggcggagccgccgctctacccgatggcgggggctgcggggccgcagggcgacgaggacctgctcggggtcccggacgggcccgaggccccgctggacgagctggtgggcgcgtaccccaactacaacgaggaggaggaggagcgccgctactaccgccgcaagcgcctgggcgtgctcaagaacgtgctggctgccagcgccgggggcatgctcacctacggcgtctacctgggcctcctgcagatgcagctgatcctgcactacgacgagacctaccgcgaggtgaagtatggcaacatggggctgcccgacatcgacagcaaaatgctgatgggcatcaacgtgactcccatcgccgccctgctctacacacctgtgctcatcaggttttttggaacgaagtggatgatgttcctcgctgtgggcatctacgccctctttgtctccaccaactactgggagcgctactacacgcttgtgccctcggctgtggccctgggcatggccatcgtgcctctttgggcttccatgggcaactacatcaccaggatggcgcagaagtaccatgagtactcccactacaaggagcaggatgggcaggggatgaagcagcggcctccgcggggctcccacgcgccctatctcctggtcttccaagccatcttctacagcttcttccatctgagcttcgcctgcgcccagctgcccatgatttatttcctgaaccactacctgtatgacctgaaccacacgctgtacaatgtgcagagctgcggcaccaacagccacgggatcctcagcggcttcaacaagacggttctgcggacgctcccgcggagcggaaacctcattgtggtggagagcgtgctcatggcagtggccttcctggccatgctgctggtgctgggtttgtgcggagccgcttaccggcccacggaggagatcgatctgcgcagcgtgggctggggcaacatcttccagctgcccttcaagcacgtgcgtgactaccgcctgcgccacctcgtgcctttctttatctacagcggcttcgaggtgctctttgcctgcactggtatcgccttgggctatggcgtgtgctcggtggggctggagcggctggcttacctcctcgtggcttacagcctgggcgcctcagccgcctcactcctgggcctgctgggcctgtggctgccacgcccggtgcccctggtggccggagcaggggtgcacctgctgctcaccttcatcctctttttctgggcccctgtgcctcgggtcctgcaacacagctggatcctctatgtggcagctgccctttggggtgtgggcagtgccctgaacaagactggactcagcacactcctgggaatcttgtacgaagacaaggagagacaggacttcatcttcaccatctaccactggtggcaggctgtggccatcttcaccgtgtacctgggctcgagcctgcacatgaaggctaagctggcggtgctgctggtgacgctggtggcggccgcggtctcctacctgcggatggagcagaagctgcgccggggcgtggccccgcgccagccccgcatcccgcggccccagcacaaggtgcgcggttaccgctacttggaggaggacaactcggacgagagcgacgcggagggcgagcatggggacggcgcggaggaggaggcgccgcccgcagggcccaggcctggccccgagcccgctggactcggccgccggccctgcccgtacgaacaggcgcaggggggagacgggccggaggagcagtgaggggccgcctggtccccggactcagcctccctcctcgccggcctcagtttaccacgtctgaggtcggggggaccccctccgagtcccgcgctgtcttcaaaggcccctgtctcccctcccccacgttggggacgcccctcccagagcccaggtcacctccgggcttccgcagccccctccaaggcggagtggagccttgggaacccctcggccaagcacaggggttcgaaaatacagctgaaaccccgcgggcccttagcacgcgccccagcgccggagcacggtcagggtcttcttgcgacccggcccgctccagatccccacagctctcggccgcggacccgggccgcgtgtgagcgcactttgcacctcctatccccagggtccgccgagagccacgattttttacagaaaatgagcaataaagagattttgtactgtcaaaaacctcgtg

SEQ ID NO: 436927 - DNA, 2328 bp, Homo sapiens
ggaaaaccagaagggaagtgaagggactgcattctctgcagggatggtctcttgttctgagagctgagtgggaaggaagccacctgggaggcgcagcaggaagagcattcaaaccagaaggaacccaggggagagaatctggatattttcaaaagtggccccgtggctccagccagctggacgagctggtgggcgcgtaccccaactacaacgaggaggaggaggagcgccgctactaccgccgcaagcgcctgggcgtgctcaagaacgtgctggctgccagcgccgggggcatgctcacctacggcgtctacctgggcctcctgcagatgcagctgatcctgcactacgacgagacctaccgcgaggtgaagtatggcaacatggggctgcccgacatcgacagcaaaatgctgatgggcatcaacgtgactcccatcgccgccctgctctacacacctgtgctcatcaggttttttggaacgaagtggatgatgttcctcgctgtgggcatctacgccctctttgtctccaccaactactgggagcgctactacacgcttgtgccctcggctgtggccctgggcatggccatcgtgcctctttgggcttccatgggcaactacatcaccaggatggcgcagaagtaccatgagtactcccactacaaggagcaggatgggcaggggatgaagcagcggcctccgcggggctcccacgcgccctatctcctggtcttccaagccatcttctacagcttcttccatctgagcttcgcctgcgcccagctgcccatgatttatttcctgaaccactacctgtatgacctgaaccacacgctgtacaatgtgcagagctgcggcaccaacagccacgggatcctcagcggcttcaacaagacggttctgcggacgctcccgcggagcggaaacctcattgtggtggagagcgtgctcatggcagtggccttcctggccatgctgctggtgctgggtttgtgcggagccgcttaccggcccacggaggagatcgatctgcgcagcgtgggctggggcaacatcttccagctgcccttcaagcacgtgcgtgactaccgcctgcgccacctcgtgcctttctttatctacagcggcttcgaggtgctctttgcctgcactggtatcgccttgggctatggcgtgtgctcggtggggctggagcggctggcttacctcctcgtggcttacagcctgggcgcctcagccgcctcactcctgggcctgctgggcctgtggctgccacgcccggtgcccctggtggccggagcaggggtgcacctgctgctcaccttcatcctctttttctgggcccctgtgcctcgggtcctgcaacacagctggatcctctatgtggcagctgccctttggggtgtgggcagtgccctgaacaagactggactcagcacactcctgggaatcttgtacgaagacaaggagagacaggacttcatcttcaccatctaccactggtggcaggctgtggccatcttcaccgtgtacctgggctcgagcctgcacatgaaggctaagctggcggtgctgctggtgacgctggtggcggccgcggtctcctacctgcggatggagcagaagctgcgccggggcgtggccccgcgccagccccgcatcccgcggccccagcacaaggtgcgcggttaccgctacttggaggaggacaactcggacgagagcgacgcggagggcgagcatggggacggcgcggaggaggaggcgccgcccgcagggcccaggcctggccccgagcccgctggactcggccgccggccctgcccgtacgaacaggcgcaggggggagacgggccggaggagcagtgaggggccgcctggtccccggactcagcctccctcctcgccggcctcagtttaccacgtctgaggtcggggggaccccctccgagtcccgcgctgtcttcaaaggcccctgtctcccctcccccacgttggggacgcccctcccagagcccaggtcacctccgggcttccgcagccccctccaaggcggagtggagccttgggaacccctcggccaagcacaggggttcgaaaatacagctgaaaccccgcgggcccttagcacgcgccccagcgccggagcacggtcagggtcttcttgcgacccggcccgctccagatccccacagctctcggccgcggacccgggccgcgtgtgagcgcactttgcacctcctatccccagggtccgccgagagccacgattttttacagaaaatgagcaataaagagattttgtactgtcaaaaacctcgtg

SEQ ID NO: 436928 - DNA, 2546 bp, Homo sapiens
ggcaggtcccggccgccgggaggaagtggccgggcggtcgcaggactccggggcgaccgccgcgagtccgcagtagttcgggccatggaggcggagccgccgctctacccgatggcgggggctgcggggccgcagggcgacgaggacctgctcggggtcccggacgggcccgaggccccgctggacgagctggtgggcgcgtaccccaactacaacgaggaggaggaggagcgccgctactaccgccgcaagcgcctgggcgtgctcaagaacgtgctggctgccagcgccgggggcatgctcacctacggcgtctacctgggcctcctgcagatgcagctgatcctgcactacgacgagacctaccgcgaggtgaagtatggcaacatggggctgcccgacatcgacagcaaaatgctgatgggcatcaacgtgactcccatcgccgccctgctctacacacctgtgctcatcaggttttttggaacgaagtggatgatgttcctcgctgtgggcatctacgccctctttgtctccaccaactactgggagcgctactacacgcttgtgccctcggctgtggccctgggcatggccatcgtgcctctttgggcttccatgggcaactacatcaccaggtgagcctggtgggcagcagggcaggagggctggagacctggccaagcctccactttattgccaactttggctgggggaccacaggaagccccttccgccctctgggcctcagtttccccacaccggggctggtctgctcctagctctgggtgcaggacacacaggagtggcacaggtcgggctggggagagccttctctcctttgtggtccaggatggcgcagaagtaccatgagtactcccactacaaggagcaggatgggcaggggatgaagcagcggcctccgcggggctcccacgcgccctatctcctggtcttccaagccatcttctacagcttcttccatctgagcttcgcctgcgcccagctgcccatgatttatttcctgaaccactacctgtatgacctgaaccacacgctgtacaatgtgcagagctgcggcaccaacagccacgggatcctcagcggcttcaacaagacggttctgcggacgctcccgcggagcggaaacctcattgtggtggagagcgtgctcatggcagtggccttcctggccatgctgctggtgctgggtttgtgcggagccgcttaccggcccacggaggagatcgatctgcgcagcgtgggctggggcaacatcttccagctgcccttcaagcacgtgcgtgactaccgcctgcgccacctcgtgcctttctttatctacagcggcttcgaggtgctctttgcctgcactggtatcgccttgggctatggcgtgtgctcggtggggctggagcggctggcttacctcctcgtggcttacagcctgggcgcctcagccgcctcactcctgggcctgctgggcctgtggctgccacgcccggtgcccctggtggccggagcaggggtgcacctgctgctcaccttcatcctctttttctgggcccctgtgcctcgggtcctgcaacacagctggatcctctatgtggcagctgccctttggggtgtgggcagtgccctgaacaagactggactcagcacactcctgggaatcttgtacgaagacaaggagagacaggacttcatcttcaccatctaccactggtggcaggctgtggccatcttcaccgtgtacctgggctcgagcctgcacatgaaggctaagctggcggtgctgctggtgacgctggtggcggccgcggtctcctacctgcggatggagcagaagctgcgccggggcgtggccccgcgccagccccgcatcccgcggccccagcacaaggtgcgcggttaccgctacttggaggaggacaactcggacgagagcgacgcggagggcgagcatggggacggcgcggaggaggaggcgccgcccgcagggcccaggcctggccccgagcccgctggactcggccgccggccctgcccgtacgaacaggcgcaggggggagacgggccggaggagcagtgaggggccgcctggtccccggactcagcctccctcctcgccggcctcagtttaccacgtctgaggtcggggggaccccctccgagtcccgcgctgtcttcaaaggcccctgtctcccctcccccacgttggggacgcccctcccagagcccaggtcacctccgggcttccgcagccccctccaaggcggagtggagccttgggaacccctcggccaagcacaggggttcgaaaatacagctgaaaccccgcgggcccttagcacgcgccccagcgccggagcacggtcagggtcttcttgcgacccggcccgctccagatccccacagctctcggccgcggacccgggccgcgtgtgagcgcactttgcacctcctatccccagggtccgccgagagccacgattttttacagaaaatgagcaataaagagattttgtactgtcaaaaacctcgtg

SEQ ID NO: 436929 - DNA, 2519 bp, Homo sapiens
ccagagcctcggtgtgggtgggggacgggggtcctgggctcccggacagacctgccaccgtcagaattggaggccggcggagcaaggcgggtgggggtctgggcttagctggccaagtggccgcgggctggcagaaggcgtggcgcagcccgggaaccccgctgtcctgaggggcgctgtcagcgggaatgccttcggtgattggagctccctgcgaggcctgcatgccgtcttctgctcggtggcgcccaaagctaggctgctccctgcacgccgctctctgtcctgtccccaggcctcctgcagatgcagctgatcctgcactacgacgagacctaccgcgaggtgaagtatggcaacatggggctgcccgacatcgacagcaaaatgctgatgggcatcaacgtgactcccatcgccgccctgctctacacacctgtgctcatcaggttttttggaacgaagtggatgatgttcctcgctgtgggcatctacgccctctttgtctccaccaactactgggagcgctactacacgcttgtgccctcggctgtggccctgggcatggccatcgtgcctctttgggcttccatgggcaactacatcaccaggtgagcctggtgggcagcagggcaggagggctggagacctggccaagcctccactttattgccaactttggctgggggaccacaggaagccccttccgccctctgggcctcagtttccccacaccggggctggtctgctcctagctctgggtgcaggacacacaggagtggcacaggtcgggctggggagagccttctctcctttgtggtccaggatggcgcagaagtaccatgagtactcccactacaaggagcaggatgggcaggggatgaagcagcggcctccgcggggctcccacgcgccctatctcctggtcttccaagccatcttctacagcttcttccatctgagcttcgcctgcgcccagctgcccatgatttatttcctgaaccactacctgtatgacctgaaccacacgctgtacaatgtgcagagctgcggcaccaacagccacgggatcctcagcggcttcaacaagacggttctgcggacgctcccgcggagcggaaacctcattgtggtggagagcgtgctcatggcagtggccttcctggccatgctgctggtgctgggtttgtgcggagccgcttaccggcccacggaggagatcgatctgcgcagcgtgggctggggcaacatcttccagctgcccttcaagcacgtgcgtgactaccgcctgcgccacctcgtgcctttctttatctacagcggcttcgaggtgctctttgcctgcactggtatcgccttgggctatggcgtgtgctcggtggggctggagcggctggcttacctcctcgtggcttacagcctgggcgcctcagccgcctcactcctgggcctgctgggcctgtggctgccacgcccggtgcccctggtggccggagcaggggtgcacctgctgctcaccttcatcctctttttctgggcccctgtgcctcgggtcctgcaacacagctggatcctctatgtggcagctgccctttggggtgtgggcagtgccctgaacaagactggactcagcacactcctgggaatcttgtacgaagacaaggagagacaggacttcatcttcaccatctaccactggtggcaggctgtggccatcttcaccgtgtacctgggctcgagcctgcacatgaaggctaagctggcggtgctgctggtgacgctggtggcggccgcggtctcctacctgcggatggagcagaagctgcgccggggcgtggccccgcgccagccccgcatcccgcggccccagcacaaggtgcgcggttaccgctacttggaggaggacaactcggacgagagcgacgcggagggcgagcatggggacggcgcggaggaggaggcgccgcccgcagggcccaggcctggccccgagcccgctggactcggccgccggccctgcccgtacgaacaggcgcaggggggagacgggccggaggagcagtgaggggccgcctggtccccggactcagcctccctcctcgccggcctcagtttaccacgtctgaggtcggggggaccccctccgagtcccgcgctgtcttcaaaggcccctgtctcccctcccccacgttggggacgcccctcccagagcccaggtcacctccgggcttccgcagccccctccaaggcggagtggagccttgggaacccctcggccaagcacaggggttcgaaaatacagctgaaaccccgcgggcccttagcacgcgccccagcgccggagcacggtcagggtcttcttgcgacccggcccgctccagatccccacagctctcggccgcggacccgggccgcgtgtgagcgcactttgcacctcctatccccagggtccgccgagagccacgattttttacagaaaatgagcaataaagagattttgtactgtcaaaaacctcgtg

SEQ ID NO: 436930 - DNA, 1326 bp, Homo sapiens
aaaggattaaatcatagagggaggagatcgatctgcgcagcgtgggctggggcaacatcttccagctgcccttcaagcacgtgcgtgactaccgcctgcgccacctcgtgcctttctttatctacagcggcttcgaggtgctctttgcctgcactggtatcgccttgggctatggcgtgtgctcggtggggctggagcggctggcttacctcctcgtggcttacagcctgggcgcctcagccgcctcactcctgggcctgctgggcctgtggctgccacgcccggtgcccctggtggccggagcaggggtgcacctgctgctcaccttcatcctctttttctgggcccctgtgcctcgggtcctgcaacacagctggatcctctatgtggcagctgccctttggggtgtgggcagtgccctgaacaagactggactcagcacactcctgggaatcttgtacgaagacaaggagagacaggacttcatcttcaccatctaccactggtggcaggctgtggccatcttcaccgtgtacctgggctcgagcctgcacatgaaggctaagctggcggtgctgctggtgacgctggtggcggccgcggtctcctacctgcggatggagcagaagctgcgccggggcgtggccccgcgccagccccgcatcccgcggccccagcacaaggtgcgcggttaccgctacttggaggaggacaactcggacgagagcgacgcggagggcgagcatggggacggcgcggaggaggaggcgccgcccgcagggcccaggcctggccccgagcccgctggactcggccgccggccctgcccgtacgaacaggcgcaggggggagacgggccggaggagcagtgaggggccgcctggtccccggactcagcctccctcctcgccggcctcagtttaccacgtctgaggtcggggggaccccctccgagtcccgcgctgtcttcaaaggcccctgtctcccctcccccacgttggggacgcccctcccagagcccaggtcacctccgggcttccgcagccccctccaaggcggagtggagccttgggaacccctcggccaagcacaggggttcgaaaatacagctgaaaccccgcgggcccttagcacgcgccccagcgccggagcacggtcagggtcttcttgcgacccggcccgctccagatccccacagctctcggccgcggacccgggccgcgtgtgagcgcactttgcacctcctatccccagggtccgccgagagccacgattttttacagaaaatgagcaataaagagattttgtactgtcaaaaacctcgtg

SEQ ID NO: 436931 - DNA, 1344 bp, Homo sapiens
agcggagtctccattggtgaggtcgtcccggagcctcgcccagctcccgcgcgctagagccgcctgctggtctcacccagccgggaccgctgacctggcgctttgtgcggctccaggcctccgagtggactccagaaagcctgaaaagctatcatggcagcaaggcccaagctccactatcccaacggaagaggccggatggagtccgtgagatgggttttagctgccgccggagtcgagtttgatgaagaatttctggaaacaaaagaacagttgtacaagttgcaggatggtaaccacctgctgttccaacaagtgcccatggttgaaattgacgggatgaagttggtacagacccgaagcattctccactacatagcagacaagcacaatctctttggcaagaacctcaaggagagaaccctgattgacatgtacgtggaggggacactggatctgctggaactgcttatcatgcatcctttcttaaaaccagatgatcagcaaaaggaagtggttaacatggcccagaaggctataattagatactttcctgtgtttgaaaagattttaaggggtcacggacaaagctttcttgttggtaatcagctgagccttgcagatgtgattttactccaaaccattttagctctagaagagaaaattcctaatatcctgtctgcatttcctttcctccaggaatacacagtgaaactaagtaatatccctacaattaagagattccttgaacctggcagcaagaagaagcctccccctgatgaaatttatgtgagaaccgtctacaacatctttaggccataaaacaacacatccatgtgtgagtgacagtgtgttcctagagatggtattgtctacagtcatgtcttaatggatcccagctctgtcatggtgctatctatgtattaagttgggtcctaagttgggtcttttgtgtcaaagagatcatctcttctagaaatatcaaccttttttgtccagtaaataattgttaggggatctttattggaaaacttttttggagaggctggtatttaagttagatctgattgggctactcatgtcctgtagccagttcatcctcataataagaatgggcaggatctcttgttctctcctgagtgtctttctactctcctgagcgtctttctgctctccttatcctgttctcttatccttatcccctccagtctctgcctaatttttagtgtttaataacaaccgaatgtctagtaaatgactctcctctgagctgtaataaataaaatggtagtaatgaatgcaatcagtgttagccaaaataaagaatttatgagtcattgctca

SEQ ID NO: 436932 - DNA, 721 bp, Homo sapiens
ctcaagcttttcattttctctgttttgggacatgtaagaggaagtctaattttataattgggttgagtttatgactacacctcttgatgttctagcagcagaactgggaaataagagtgggccccttgaagatgatctatcacttagatttcttaaatcaccctgcccctccccaagcctcctgcatgcatttctgtagatacatttttggagtagatatatcctttcaaaacaccagatgctaaatccagaaataaggaattttcccttccccacttcaatgtctcattcagatccacagcagatatttaaggatgctttcatttccacaccttttttgtactttctctctctctctctcgctctctctctctctctctccccctctctctcactctctctgtcagatatagggtgcgttctcttaattgatgttatttatgaaagcatgaaatgacaaggtcatagtttcacctcttctcagatactgcactgattcaatagcctcatcactctctccatgtggaatattgtaactgatgcacaccatttccctacaattttaaggggtcacggacaaagctttcttgttggtaatcagctgagccttgcagatgtgattttactccaaaccattttagctctagaagagaaaattcctaatatcctgtctgcatttcctttcctccaggtaaataaaactatgtattagaagaaaaaa

SEQ ID NO: 436933 - DNA, 1037 bp, Homo sapiens
cagatttggtagggattccccttacagggccctccatgcctttctctttcacatttgagcacttccttgctttctggcataacaaaatcaaccttctcttataggacccctagttccttttagggggcagtgatatttagaaaccaagatgtggatgctaagtctgctctttctctctgcttcttaagactgtttaacttggcattttttgtcctgagcctgtatgatatttacctccttttggagggtgaggatatctttttaaaaaattgatgcataatgtacatatttggggaatacatttgatattttgatacatgtgtatcatgtgtagtgatcaaatcagggtaattaggatatccatcacccacctcaaacatttatctttcctttatggcggaacattccaattctcttctagccattttgaactgtgtaatacgttattgttaactatagcctactgtactatcgaacactagattttatttcttctgtctagctgtatttatgtaccattaaccaacctcttttcacatcccattcctctctacacttcccagcctctagtaagcaccaatcaactttctatttccatgagatccacttttttagctcccacatatgaatcagaacatgcagtctttgtctttctgtgcctggcttatttcacttaacgtaatgacctctgtttctgttggtgttgctgaaaatgacaggattttgttttcttaatggctgaataatattccactatgtatatatacgtttcttttttaaaaatttagtttgatgaagaatttctggaaacaaaagaacagttgtacaagttgcaggatggtgagtatgaaaatgaaacaactgcctctaatactgattttcctttaagagctgctgtttatgtggaagggcaaaagtattcaatgacactgaacattcagaacagtatcctaaaaccaaaaaaagcaagagggaataaatagttgaaattgccaggaaatcacttcttattcaatagttccataaaagctggccga

SEQ ID NO: 436934 - DNA, 918 bp, Homo sapiens
agcggagtctccattggtgaggtcgtcccggagcctcgcccagctcccgcgcgctagagccgcctgctggtctcacccagccgggaccgctgacctggcgctttgtgcggctccaggcctccgagtggactccagaaagcctgaaaagctatcatggcagcaaggcccaagctccactatcccaacggaagaggccggatggagtccgtgagatgggttttagctgccgccggagtcgagtttgatgaagaatttctggaaacaaaagaacagttgtacaagttgcaggatggattgacatgtacgtggaggggacactggatctgctggaactgcttatcatgcatcctttcttaaaaccagatgatcagcaaaaggaagtggttaacatggcccagaaggctataattagatactttcctgtgtttgaaaaggcactttgtgaatgtaaaataggataatgaagaaatgtggtctggaacgggcacagaggacctggtgctttggcaaaggttcactgctcattcttaggtcccaagggcccagactgtgtcagggtttcttgcaacacgcctatgaggtgagaaccgttgtcccttttacacataatgaaatgaagtcatgaagagattcagtgacctgtccaaggtaacatggccagaaaatggagagcagggttggaactctggcctctgactacaaattcaggatgcattgtactatgccactctggctccagtagctatatttgacctggaattgtgttcggagtccctgtgacacacacacttgtgcacatgcagacacccatgggcatccaagagttgactgtgaaggggatctcccctttgctactactgcttcttgcctctccctaatcacaatctattcttataagccccacacctatacgttacc

SEQ ID NO: 436935 - DNA, 2135 bp, Homo sapiens
agcggagtctccattggtgaggtcgtcccggagcctcgcccagctcccgcgcgctagagccgcctgctggtctcacccagccgggaccgctgacctggcgctttgtgcggctccaggcctccgagtggactccagaaagcctgaaaagctatcatggcagcaaggcccaagctccactatcccaacggaagaggccggatggagtccgtgagatgggttttagctgccgccggagtcgagtttgatgaagaatttctggaaacaaaagaacagttgtacaagttgcaggatggtaaccacctgctgttccaacaagtgcccatggttgaaattgacgggatgaagttggtacagacccgaagcattctccactacatagcagacaagcacaatctctttggcaagaacctcaaggagagaaccctgtactgtggcccctctcgagtgttgtcacttgtcagcttactgatgccttagctgattagcaacctctgtagcacaccacatttactttatgtcttacatagttagtgagatcagggaacaaaaacccaagaaggtcacgaagaccagttggaacttcagtagagagagtctgagttcagatttcaacatttttaaatgctttgatactgctttttccctttcttgcacattcactattgttaagtattaggaatgaggagctgctgtgacattcaaggcctgggagagtgagcattagattataatttgaaatcaaagcctggtccttgcaccccttagatgtatgaccctgggcaacgtgggtataagaatagtacatttctcatagtgtcatgtgatttaatgagataatggatagagagtgtttagcaccatgcctggtacactctaagcactcaataagtggtattcactatttttataaagttgaagtttgacccatacgaagagaccaaaacatggatgctggggtaaaagtggaggagtaggatgccaggagagagagcactcatgactgtcaagctgtctgatctgtgacagatttttctgagttacaactagaattgaccttatatctttgctcttaagagacaggtataggtaaatgcttctagggacttaagttgcagcatctttaaaaaaaaaaaaaaaagcactctgaattcttagttgtggaaactgatggcttcaaagagaggagaaactgagacaactgcttttttgttttaaggattgacatgtacgtggaggggacactggatctgctggaactgcttatcatgcatcctttcttaaaaccagatgatcagcaaaaggaagtggttaacatggcccagaaggctataattagatactttcctgtgtttgaaaagattttaaggggtcacggacaaagctttcttgttggtaatcagctgagccttgcagatgtgattttactccaaaccattttagctctagaagagaaaattcctaatatcctgtctgcatttcctttcctccaggaatacacagtgaaactaagtaatatccctacaattaagagattccttgaacctggcagcaagaagaagcctccccctgatgaaatttatgtgagaaccgtctacaacatctttaggccataaaacaacacatccatgtgtgagtgacagtgtgttcctagagatggtattgtctacagtcatgtcttaatggatcccagctctgtcatggtgctatctatgtattaagttgggtcctaagttgggtcttttgtgtcaaagagatcatctcttctagaaatatcaaccttttttgtccagtaaataattgttaggggatctttattggaaaacttttttggagaggctggtatttaagttagatctgattgggctactcatgtcctgtagccagttcatcctcataataagaatgggcaggatctcttgttctctcctgagtgtctttctactctcctgagcgtctttctgctctccttatcctgttctcttatccttatcccctccagtctctgcctaatttttagtgtttaataacaaccgaatgtctagtaaatgactctcctctgagctgtaataaataaaatggtagtaatgaatgcaatcagtgttagccaaaataaagaatttatgagtcattgctca

SEQ ID NO: 436936 - DNA, 1892 bp, Homo sapiens
cagatttggtagggattccccttacagggccctccatgcctttctctttcacatttgagcacttccttgctttctggcataacaaaatcaaccttctcttataggacccctagttccttttagggggcagtgatatttagaaaccaagatgtggatgctaagtctgctctttctctctgcttcttaagactgtttaacttggcattttttgtcctgagcctgtatgatatttacctccttttggagggtgaggatatctttttaaaaaattgatgcataatgtacatatttggggaatacatttgatattttgatacatgtgtatcatgtgtagtgatcaaatcagggtaattaggatatccatcacccacctcaaacatttatctttcctttatggcggaacattccaattctcttctagccattttgaactgtgtaatacgttattgttaactatagcctactgtactatcgaacactagattttatttcttctgtctagctgtatttatgtaccattaaccaacctcttttcacatcccattcctctctacacttcccagcctctagtaagcaccaatcaactttctatttccatgagatccacttttttagctcccacatatgaatcagaacatgcagtctttgtctttctgtgcctggcttatttcacttaacgtaatgacctctgtttctgttggtgttgctgaaaatgacaggattttgttttcttaatggctgaataatattccactatgtatatatacgtttcttttttaaaaatttagtttgatgaagaatttctggaaacaaaagaacagttgtacaagttgcaggatggtaaccacctgctgttccaacaagtgcccatggttgaaattgacgggatgaagttggtacagacccgaagcattctccactacatagcagacaagcacaatctctttggcaagaacctcaaggagagaaccctgattgacatgtacgtggaggggacactggatctgctggaactgcttatcatgcatcctttcttaaaaccagatgatcagcaaaaggaagtggttaacatggcccagaaggctataattagatactttcctgtgtttgaaaagattttaaggggtcacggacaaagctttcttgttggtaatcagctgagccttgcagatgtgattttactccaaaccattttagctctagaagagaaaattcctaatatcctgtctgcatttcctttcctccaggaatacacagtgaaactaagtaatatccctacaattaagagattccttgaacctggcagcaagaagaagcctccccctgatgaaatttatgtgagaaccgtctacaacatctttaggccataaaacaacacatccatgtgtgagtgacagtgtgttcctagagatggtattgtctacagtcatgtcttaatggatcccagctctgtcatggtgctatctatgtattaagttgggtcctaagttgggtcttttgtgtcaaagagatcatctcttctagaaatatcaaccttttttgtccagtaaataattgttaggggatctttattggaaaacttttttggagaggctggtatttaagttagatctgattgggctactcatgtcctgtagccagttcatcctcataataagaatgggcaggatctcttgttctctcctgagtgtctttctactctcctgagcgtctttctgctctccttatcctgttctcttatccttatcccctccagtctctgcctaatttttagtgtttaataacaaccgaatgtctagtaaatgactctcctctgagctgtaataaataaaatggtagtaatgaatgcaatcagtgttagccaaaataaagaatttatgagtcattgctca

SEQ ID NO: 436937 - DNA, 2195 bp, Homo sapiens
gggacaacaggcatctgctaccacacccggctaatttttgtatatctagtagaggcggggtttcactatgttggccaggctggtcttgaactcctgacctcatgatccgcctgccttggcctcccaaagtgctgggattacaggcttgagccaccacgcctggccccttcaggcttcttttgtggctaaatctgctctcctgaatgaagttaaggttatctgtcatctggaagctttacactatttcctaaggccatgattccaccgtttcttttcattccacagagcattttttaggggttgggggacagagaagaaaagatcacttctaactctgggcttccattctcaggtaaccacctgctgttccaacaagtgcccatggttgaaattgacgggatgaagttggtacagacccgaagcattctccactacatagcagacaagcacaatctctttggcaagaacctcaaggagagaaccctgtactgtggcccctctcgagtgttgtcacttgtcagcttactgatgccttagctgattagcaacctctgtagcacaccacatttactttatgtcttacatagttagtgagatcagggaacaaaaacccaagaaggtcacgaagaccagttggaacttcagtagagagagtctgagttcagatttcaacatttttaaatgctttgatactgctttttccctttcttgcacattcactattgttaagtattaggaatgaggagctgctgtgacattcaaggcctgggagagtgagcattagattataatttgaaatcaaagcctggtccttgcaccccttagatgtatgaccctgggcaacgtgggtataagaatagtacatttctcatagtgtcatgtgatttaatgagataatggatagagagtgtttagcaccatgcctggtacactctaagcactcaataagtggtattcactatttttataaagttgaagtttgacccatacgaagagaccaaaacatggatgctggggtaaaagtggaggagtaggatgccaggagagagagcactcatgactgtcaagctgtctgatctgtgacagatttttctgagttacaactagaattgaccttatatctttgctcttaagagacaggtataggtaaatgcttctagggacttaagttgcagcatctttaaaaaaaaaaaaaaaagcactctgaattcttagttgtggaaactgatggcttcaaagagaggagaaactgagacaactgcttttttgttttaaggattgacatgtacgtggaggggacactggatctgctggaactgcttatcatgcatcctttcttaaaaccagatgatcagcaaaaggaagtggttaacatggcccagaaggctataattagatactttcctgtgtttgaaaagattttaaggggtcacggacaaagctttcttgttggtaatcagctgagccttgcagatgtgattttactccaaaccattttagctctagaagagaaaattcctaatatcctgtctgcatttcctttcctccaggaatacacagtgaaactaagtaatatccctacaattaagagattccttgaacctggcagcaagaagaagcctccccctgatgaaatttatgtgagaaccgtctacaacatctttaggccataaaacaacacatccatgtgtgagtgacagtgtgttcctagagatggtattgtctacagtcatgtcttaatggatcccagctctgtcatggtgctatctatgtattaagttgggtcctaagttgggtcttttgtgtcaaagagatcatctcttctagaaatatcaaccttttttgtccagtaaataattgttaggggatctttattggaaaacttttttggagaggctggtatttaagttagatctgattgggctactcatgtcctgtagccagttcatcctcataataagaatgggcaggatctcttgttctctcctgagtgtctttctactctcctgagcgtctttctgctctccttatcctgttctcttatccttatcccctccagtctctgcctaatttttagtgtttaataacaaccgaatgtctagtaaatgactctcctctgagctgtaataaataaaatggtagtaatgaatgcaatcagtgttagccaaaataaagaatttatgagtcattgctca

SEQ ID NO: 436938 - DNA, 2141 bp, Homo sapiens
gggacaacaggcatctgctaccacacccggctaatttttgtatatctagtagaggcggggtttcactatgttggccaggctggtcttgaactcctgacctcatgatccgcctgccttggcctcccaaagtgctgggattacaggcttgagccaccacgcctggccccttcaggcttcttttgtggctaaatctgctctcctgaatgaagttaaggttatctgtcatctggaagctttacactatttcctaaggccatgattccaccgtttcttttcattccacagagcattttttaggggttgggggacagagaagaaaaagtgcccatggttgaaattgacgggatgaagttggtacagacccgaagcattctccactacatagcagacaagcacaatctctttggcaagaacctcaaggagagaaccctgtactgtggcccctctcgagtgttgtcacttgtcagcttactgatgccttagctgattagcaacctctgtagcacaccacatttactttatgtcttacatagttagtgagatcagggaacaaaaacccaagaaggtcacgaagaccagttggaacttcagtagagagagtctgagttcagatttcaacatttttaaatgctttgatactgctttttccctttcttgcacattcactattgttaagtattaggaatgaggagctgctgtgacattcaaggcctgggagagtgagcattagattataatttgaaatcaaagcctggtccttgcaccccttagatgtatgaccctgggcaacgtgggtataagaatagtacatttctcatagtgtcatgtgatttaatgagataatggatagagagtgtttagcaccatgcctggtacactctaagcactcaataagtggtattcactatttttataaagttgaagtttgacccatacgaagagaccaaaacatggatgctggggtaaaagtggaggagtaggatgccaggagagagagcactcatgactgtcaagctgtctgatctgtgacagatttttctgagttacaactagaattgaccttatatctttgctcttaagagacaggtataggtaaatgcttctagggacttaagttgcagcatctttaaaaaaaaaaaaaaaagcactctgaattcttagttgtggaaactgatggcttcaaagagaggagaaactgagacaactgcttttttgttttaaggattgacatgtacgtggaggggacactggatctgctggaactgcttatcatgcatcctttcttaaaaccagatgatcagcaaaaggaagtggttaacatggcccagaaggctataattagatactttcctgtgtttgaaaagattttaaggggtcacggacaaagctttcttgttggtaatcagctgagccttgcagatgtgattttactccaaaccattttagctctagaagagaaaattcctaatatcctgtctgcatttcctttcctccaggaatacacagtgaaactaagtaatatccctacaattaagagattccttgaacctggcagcaagaagaagcctccccctgatgaaatttatgtgagaaccgtctacaacatctttaggccataaaacaacacatccatgtgtgagtgacagtgtgttcctagagatggtattgtctacagtcatgtcttaatggatcccagctctgtcatggtgctatctatgtattaagttgggtcctaagttgggtcttttgtgtcaaagagatcatctcttctagaaatatcaaccttttttgtccagtaaataattgttaggggatctttattggaaaacttttttggagaggctggtatttaagttagatctgattgggctactcatgtcctgtagccagttcatcctcataataagaatgggcaggatctcttgttctctcctgagtgtctttctactctcctgagcgtctttctgctctccttatcctgttctcttatccttatcccctccagtctctgcctaatttttagtgtttaataacaaccgaatgtctagtaaatgactctcctctgagctgtaataaataaaatggtagtaatgaatgcaatcagtgttagccaaaataaagaatttatgagtcattgctca

SEQ ID NO: 436939 - DNA, 1299 bp, Homo sapiens
agcggagtctccattggtgaggtcgtcccggagcctcgcccagctcccgcgcgctagagccgcctgctggtctcacccagccgggaccgctgacctggcgctttgtgcggctccaggcctccgagtggactccagtgagggaaaatgcagcaacaaaaataaagaacagtttcccgtgccaaaatcctgaatattcatttcgcccctgagcactgggttgaagacgcgaaattgggactgttggtctgcgacgagctgctgcatttgtatttcagaaagcctgaaaagctatcatggcagcaaggcccaagctccactatcccaacggaagaggccggatggagtccgtgagatgggttttagctgccgccggagtcgaggattgacatgtacgtggaggggacactggatctgctggaactgcttatcatgcatcctttcttaaaaccagatgatcagcaaaaggaagtggttaacatggcccagaaggctataattagatactttcctgtgtttgaaaagattttaaggggtcacggacaaagctttcttgttggtaatcagctgagccttgcagatgtgattttactccaaaccattttagctctagaagagaaaattcctaatatcctgtctgcatttcctttcctccaggaatacacagtgaaactaagtaatatccctacaattaagagattccttgaacctggcagcaagaagaagcctccccctgatgaaatttatgtgagaaccgtctacaacatctttaggccataaaacaacacatccatgtgtgagtgacagtgtgttcctagagatggtattgtctacagtcatgtcttaatggatcccagctctgtcatggtgctatctatgtattaagttgggtcctaagttgggtcttttgtgtcaaagagatcatctcttctagaaatatcaaccttttttgtccagtaaataattgttaggggatctttattggaaaacttttttggagaggctggtatttaagttagatctgattgggctactcatgtcctgtagccagttcatcctcataataagaatgggcaggatctcttgttctctcctgagtgtctttctactctcctgagcgtctttctgctctccttatcctgttctcttatccttatcccctccagtctctgcctaatttttagtgtttaataacaaccgaatgtctagtaaatgactctcctctgagctgtaataaataaaatggtagtaatgaatgcaatcagtgttagccaaaataaagaatttatgagtcattgctca

SEQ ID NO: 436940 - DNA, 1267 bp, Homo sapiens
agcggagtctccattggtgaggtcgtcccggagcctcgcccagctcccgcgcgctagagccgcctgctggtctcacccagccgggaccgctgacctggcgctttgtgcggctccaggcctccgagtggactccagaaagcctgaaaagctatcatggcagcaaggcccaagctccactatcccaacggaagaggccggatggagtccgtgagatgggttttagctgccgccggagtcgagtttgatgaagaatttctggaaacaaaagaacagttgtacaagttgcaggatggtaaccacctgctgttccaacaagtgcccatggttgaaattgacgggatgaagttggattgacatgtacgtggaggggacactggatctgctggaactgcttatcatgcatcctttcttaaaaccagatgatcagcaaaaggaagtggttaacatggcccagaaggctataattagatactttcctgtgtttgaaaagattttaaggggtcacggacaaagctttcttgttggtaatcagctgagccttgcagatgtgattttactccaaaccattttagctctagaagagaaaattcctaatatcctgtctgcatttcctttcctccaggaatacacagtgaaactaagtaatatccctacaattaagagattccttgaacctggcagcaagaagaagcctccccctgatgaaatttatgtgagaaccgtctacaacatctttaggccataaaacaacacatccatgtgtgagtgacagtgtgttcctagagatggtattgtctacagtcatgtcttaatggatcccagctctgtcatggtgctatctatgtattaagttgggtcctaagttgggtcttttgtgtcaaagagatcatctcttctagaaatatcaaccttttttgtccagtaaataattgttaggggatctttattggaaaacttttttggagaggctggtatttaagttagatctgattgggctactcatgtcctgtagccagttcatcctcataataagaatgggcaggatctcttgttctctcctgagtgtctttctactctcctgagcgtctttctgctctccttatcctgttctcttatccttatcccctccagtctctgcctaatttttagtgtttaataacaaccgaatgtctagtaaatgactctcctctgagctgtaataaataaaatggtagtaatgaatgcaatcagtgttagccaaaataaagaatttatgagtcattgctca

SEQ ID NO: 436941 - DNA, 1408 bp, Homo sapiens
agcggagtctccattggtgaggtcgtcccggagcctcgcccagctcccgcgcgctagagccgcctgctggtctcacccagccgggaccgctgacctggcgctttgtgcggctccaggcctccgagtggactccagtgagggaaaatgcagcaacaaaaataaagaacagtttcccgtgccaaaatcctgaatattcatttcgcccctgagcactgggttgaagacgcgaaattgggactgttggtctgcgacgagctgctgcatttgtatttcagaaagcctgaaaagctatcatggcagcaaggcccaagctccactatcccaacggaagaggccggatggagtccgtgagatgggttttagctgccgccggagtcgaggtaaccacctgctgttccaacaagtgcccatggttgaaattgacgggatgaagttggtacagacccgaagcattctccactacatagcagacaagcacaatctctttgggattgacatgtacgtggaggggacactggatctgctggaactgcttatcatgcatcctttcttaaaaccagatgatcagcaaaaggaagtggttaacatggcccagaaggctataattagatactttcctgtgtttgaaaagattttaaggggtcacggacaaagctttcttgttggtaatcagctgagccttgcagatgtgattttactccaaaccattttagctctagaagagaaaattcctaatatcctgtctgcatttcctttcctccaggaatacacagtgaaactaagtaatatccctacaattaagagattccttgaacctggcagcaagaagaagcctccccctgatgaaatttatgtgagaaccgtctacaacatctttaggccataaaacaacacatccatgtgtgagtgacagtgtgttcctagagatggtattgtctacagtcatgtcttaatggatcccagctctgtcatggtgctatctatgtattaagttgggtcctaagttgggtcttttgtgtcaaagagatcatctcttctagaaatatcaaccttttttgtccagtaaataattgttaggggatctttattggaaaacttttttggagaggctggtatttaagttagatctgattgggctactcatgtcctgtagccagttcatcctcataataagaatgggcaggatctcttgttctctcctgagtgtctttctactctcctgagcgtctttctgctctccttatcctgttctcttatccttatcccctccagtctctgcctaatttttagtgtttaataacaaccgaatgtctagtaaatgactctcctctgagctgtaataaataaaatggtagtaatgaatgcaatcagtgttagccaaaataaagaatttatgagtcattgctca

SEQ ID NO: 436942 - DNA, 1070 bp, Homo sapiens
agcggagtctccattggtgaggtcgtcccggagcctcgcccagctcccgcgcgctagagccgcctgctggtctcacccagccgggaccgctgacctggcgctttgtgcggctccaggcctccgagtggactccagaaagcctgaaaagctatcatggcagcaaggcccaagctccactatcccaacggaagaggccggatggagtccgtgagatgggttttagctgccgccggagtcgagtttgatgaagaatttctggaaacaaaagaacagttgtacaagttgcaggatggtaaccacctgctgttccaacaagtgcccatggttgaaattgacgggatgaagttggtacagacccgaagcattctccactacatagcagacaagcacaatctctttggcaagaacctcaaggagagaaccctgaatacacagtgaaactaagtaatatccctacaattaagagattccttgaacctggcagcaagaagaagcctccccctgatgaaatttatgtgagaaccgtctacaacatctttaggccataaaacaacacatccatgtgtgagtgacagtgtgttcctagagatggtattgtctacagtcatgtcttaatggatcccagctctgtcatggtgctatctatgtattaagttgggtcctaagttgggtcttttgtgtcaaagagatcatctcttctagaaatatcaaccttttttgtccagtaaataattgttaggggatctttattggaaaacttttttggagaggctggtatttaagttagatctgattgggctactcatgtcctgtagccagttcatcctcataataagaatgggcaggatctcttgttctctcctgagtgtctttctactctcctgagcgtctttctgctctccttatcctgttctcttatccttatcccctccagtctctgcctaatttttagtgtttaataacaaccgaatgtctagtaaatgactctcctctgagctgtaataaataaaatggtagtaatgaatgcaatcagtgttagccaaaataaagaatttatgagtcattgctca

SEQ ID NO: 436943 - DNA, 1369 bp, Homo sapiens
agcggagtctccattggtgaggtcgtcccggagcctcgcccagctcccgcgcgctagagccgcctgctggtctcacccagccgggaccgctgacctggcgctttgtgcggctccaggcctccgagtggactccagtgagggaaaatgcagcaacaaaaataaagaacagtttcccgtgccaaaatcctgaatattcatttcgcccctgagcactgggttgaagacgcgaaattgggactgttggtctgcgacgagctgctgcatttgtatttcagaaagcctgaaaagctatcatggcagcaaggcccaagctccactatcccaacggaagaggccggatggagtccgtgagatgggttttagctgccgccggagtcgagtttgatgaagaatttctggaaacaaaagaacagttgtacaagttgcaggatggtaaccacctgctgttccaacaagtgcccatggttgaaattgacgggatgaagttggattgacatgtacgtggaggggacactggatctgctggaactgcttatcatgcatcctttcttaaaaccagatgatcagcaaaaggaagtggttaacatggcccagaaggctataattagatactttcctgtgtttgaaaagattttaaggggtcacggacaaagctttcttgttggtaatcagctgagccttgcagatgtgattttactccaaaccattttagctctagaagagagaatacacagtgaaactaagtaatatccctacaattaagagattccttgaacctggcagcaagaagaagcctccccctgatgaaatttatgtgagaaccgtctacaacatctttaggccataaaacaacacatccatgtgtgagtgacagtgtgttcctagagatggtattgtctacagtcatgtcttaatggatcccagctctgtcatggtgctatctatgtattaagttgggtcctaagttgggtcttttgtgtcaaagagatcatctcttctagaaatatcaaccttttttgtccagtaaataattgttaggggatctttattggaaaacttttttggagaggctggtatttaagttagatctgattgggctactcatgtcctgtagccagttcatcctcataataagaatgggcaggatctcttgttctctcctgagtgtctttctactctcctgagcgtctttctgctctccttatcctgttctcttatccttatcccctccagtctctgcctaatttttagtgtttaataacaaccgaatgtctagtaaatgactctcctctgagctgtaataaataaaatggtagtaatgaatgcaatcagtgttagccaaaataaagaatttatgagtcattgctca

SEQ ID NO: 436944 - DNA, 1898 bp, Homo sapiens
agcggagtctccattggtgaggtcgtcccggagcctcgcccagctcccgcgcgctagagccgcctgctggtctcacccagccgggaccgctgacctggcgctttgtgcggctccaggcctccgagtggactccagaaagcctgaaaagctatcatggcagcaaggcccaagctccactatcccaacggaagaggccggatggagtccgtgagatgggttttagctgccgccggagtcgagtttgatgaagaatttctggaaacaaaagaacagttgtacaagttgcaggatggtaaccacctgctgttccaacaagtgcccatggttgaaattgacgggatgaagttggtacagacccgaagcattctccactacatagcagacaagcacaatctctttggcaagaacctcaaggagagaaccctgtactgtggcccctctcgagtgttgtcacttgtcagcttactgatgccttagctgattagcaacctctgtagcacaccacatttactttatgtcttacatagttagtgagatcagggaacaaaaacccaagaaggtcacgaagaccagttggaacttcagtagagagagtctgagttcagatttcaacatttttaaatgctttgatactgctttttccctttcttgcacattcactattgttaagtattaggaatgaggagctgctgtgacattcaaggcctgggagagtgagcattagattataatttgaaatcaaagcctggtccttgcaccccttagatgtatgaccctgggcaacgtgggtataagaatagtacatttctcatagtgtcatgtgatttaatgagataatggatagagagtgtttagcaccatgcctggtacactctaagcactcaataagtggtattcactatttttataaagttgaagtttgacccatacgaagagaccaaaacatggatgctggggtaaaagtggaggagtaggatgccaggagagagagcactcatgactgtcaagctgtctgatctgtgacagatttttctgagttacaactagaattgaccttatatctttgctcttaagagacaggtataggtaaatgcttctagggacttaagttgcagcatctttaaaaaaaaaaaaaaaagcactctgaattcttagttgtggaaactgatggcttcaaagagaggagaaactgagacaactgcttttttgttttaaggattgacatgtacgtggaggggacactggatctgctggaactgcttatcatgcatcctttcttaaaaccagatgatcagcaaaaggaagtggttaacatggcccagaaggctataattagatactttcctgtgtttgaaaagctggcagcaagaagaagcctccccctgatgaaatttatgtgagaaccgtctacaacatctttaggccataaaacaacacatccatgtgtgagtgacagtgtgttcctagagatggtattgtctacagtcatgtcttaatggatcccagtgtcaaagagatcatctcttctagaaatatcaaccttttttgtccagtaaataattgttaggggatctttattggaaaacttttttggagaggctggtatttaagttagatctgattgggctactcatgtcctgtagccagttcatcctcataataagaatgggcaggatctcttgttctctcctgagtgtctttctactctcctgagcgtctttctgctctccttatcctgttctcttatccttatcccctccagtctctgcctaatttttagtgtttaataacaaccgaatgtctagtaaatgactctcctctgagctgtaataaataaaatggtagtaatgaatgcaatcagtgttagccaaaataaagaatttatgagtcattgctca

SEQ ID NO: 436945 - DNA, 847 bp, Homo sapiens
agcggagtctccattggtgaggtcgtcccggagcctcgcccagctcccgcgcgctagagccgcctgctggtctcacccagccgggaccgctgacctggcgctttgtgcggctccaggcctccgagtggactccagaaagcctgaaaagctatcatggcagcaaggcccaagctccactatcccaacggaagaggccggatggagtccgtgagatgggttttagctgccgccggagtcgagtttgatgaagaatttctggaaacaaaagaacagttgtacaagttgcaggatggtaaccacctgctgttccaacaagtgcccatggttgaaattgacgggatgaagttggtacagacccgaagcattctccactacatagcagacaagcacaatctctttggcaagaacctcaaggagagaaccctgattgacatgtacgtggaggggacactggatctgctggaactgcttatcatgcatcctttcttaaaaccagatgatcagcaaaaggaagtggttaacatggcccagaaggctataattagatactttcctgtgtttgaaaagattttaaggggtcacggacaaagctttcttgttggtaatcagctgagccttgcagatccgctatccgtcgacggatagcggatctgctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccaatggtgcagatcccgctatccgt

SEQ ID NO: 436946 - DNA, 1200 bp, Homo sapiens
agcggagtctccattggtgaggtcgtcccggagcctcgcccagctcccgcgcgctagagccgcctgctggtctcacccagccgggaccgctgacctggcgctttgtgcggctccaggcctccgagtggactccagaaagcctgaaaagctatcatggcagcaaggcccaagctccactatcccaacggaagaggccggatggagtccgtgagatgggttttagctgccgccggagtcgaggtaccttatatgctgtttcttcacggatttgtcatacagcttttgagacctttgaaagaaaaatacgttttgaagcaccgttcagttctagttctcgtccaccaaaatcacaggcacgcttcactgagtcagataccatccctgaagggatttttctttataattagaacgtagttgatggaattctattttccttttgacttttacttaattattggcttctgatctagcaccagtgaatatttattaataagaagaaaggaaatttacctgaaaattgtcagttactctgagctcttattaattatgcattctcagggtaaatttcttgttttcttcagtggcttcaaactggcagccttggtatcttgcttacatatgtgtgtgtgtctgtttttgttttcgttctgttcttttagcttcttagtatggaaattttcaaataccaataaatgtagagagaacattgccatgaattctatgtactcatcacccgacttcagcaatcatcagctctatgctaatcttgtttcatctatcacctcccttcccttgttttgtgggagtattttaaagcaaaatccaaacatcataacatttcatctgggagttcctcaacattttcctctaacagatgaggattttaaaatgtaacaatattattatcacatccaacaaaattagcaattctttgtcatctaaccttcagtctgattgtctcaaacaggcattttgtttgtttgtttgtttttatagtttgttttagtttggatctagacattggtctacgcattacatttaaaatggttatgtttctttcggtattttaaaaacctgtaagtttcctcttcattttttacaaatttatatttgggaatattttcagatttatagaaaagttgtaaaataatacagtcccactgcattccagcctggacaacagaacgagactccatctca

SEQ ID NO: 436947 - DNA, 307 bp, Homo sapiens
gtctgtctccctcctgcggtcgcccccttcctcgccctttctctcttcttttttttccctcccctttactctctgagtctcactctcgcattcttccctcactcccccagttcagtccttctcttgtcttttcttcctcttgtcctttgtcctcctgctccatccagtctgggcagaggtgggccccttggctggagctggggtccttcttggctcagtgtgcgtatttttttttaaaccccttctgcggagtctgaatgcattggtggaaggtgggctcggatcgtccccgggcctggctgggctg

SEQ ID NO: 436948 - DNA, 474 bp, Homo sapiens
tgcacattcactattgttaagtattaggaatgaggagctgctgtgacattcaaggcctgggagagtgagcattagattataatttgaaatcaaagcctggtccttgcaccccttagatgtatgaccctgggcaacgtgggtataagaatagtacatttctcatagtgtcatgtgatttaatgagataatggatagagagtgtttagcaccatgcctggtacactctaagcactcaataagtggtattcactatttttataaagttgaagtttgacccatacgaagagaccaaaacatggatgctggggtaaaagtggaggagtaggatgccaggagagagagcactcatgactgtcaagctgtctgatctgtgacagatttttctgagttacaactagaattgaccttatatctttgctcttaagagacaggtataggtaaatgcttctagggacttaagttgcagcatcttta

SEQ ID NO: 436949 - DNA, 488 bp, Homo sapiens
aaaaacccaagaaggtcacgaagaccagttggaacttcagtagagagagtctgagtaaaacaaaagaataggattcagatattgaatattatatctagggtgtcattgtttcagatttcaacatttttaaatgctttgatactgctttttccctttcttgcacattcactattgttaagtattaggaatgaggagctgctgtgacattcaaggcctgggagagtgagcattagattataatttgaaatcaaagcctggtccttgcaccccttagatgtatgaccctgggcaacgtgggtataagaatagtacatttctcatagtgtcatgtgatttaatgagataatggatagagagtgtttagcaccatgcctggtacactctaagcactcaataagtggtattcactatttttataaagttgaagtttgacccatacgaagagaccaaaacatggatgctggggtaaaagtggaggagtaggatgc

SEQ ID NO: 436950 - DNA, 935 bp, Homo sapiens
  misc_feature (853)..(853): n is a, c, g, or t
agcggagtctccattggtgaggtcgtcccggagcctcgcccagctcccgcgcgctagagccgcctgctggtctcacccagccgggaccgctgacctggcgctttgtgcggctccaggcctccgagtggactccagaaagcctgaaaagctatcatggcagcaaggcccaagctccactatcccaacggaagaggccggatggagtccgtgagatgggttttagctgccgccggagtcgagtttgatgaagaatttctggaaacaaaagaacagttgtacaagttgcaggatggtaaccacctgctgttccaacaagtgcccatggttgaaattgacgggatgaagttggtacagacccgaagcattctccactacatagcagacaagcacaatctctttggcaagaacctcaaggagagaaccctgattgacatgtacgtggaggggacactggatctgctggaactgcttatcatgcatcctttcttaaaaccagatgatcagcaaaaggaagtggttaacatggcccagaaggctataattagatactttcctgtgtttgaaaagattttaaggggtcacggacaaagctttcttgttggtaatcagctgagccttgcagatgtgattttactccaaaccattttagctctagaagagaaaattcctaatatcctgtctgcatttcctttcctccaggaatacacagtgaaactaagtaatatccctacaattaagagattccttgaacctggcagcaagaagaagcctccccctgatgaaatttatgtgagaaccgtctacaacatctttaggccataaaacaacacatccatgtgtgagtgaccgggtnccacaacagtttggttcagccgcttatgggccctcggcgggcctttttaggggccaccggcgctgggcaaaaaacttaaaac

SEQ ID NO: 436951 - DNA, 1311 bp, Homo sapiens
gtctcactctcgcattcttccctcactcccccagttcagtccttctcttgtcttttcttcctcttgtcctttgtcctcctgctccatccagtctgggcagagaaagcctgaaaagctatcatggcagcaaggcccaagctccactatcccaacggaagaggccggatggagtccgtgagatgggttttagctgccgccggagtcgagtttgatgaagaatttctggaaacaaaagaacagttgtacaagttgcaggatggtaaccacctgctgttccaacaagtgcccatggttgaaattgacgggatgaagttggtacagacccgaagcattctccactacatagcagacaagcacaatctctttggcaagaacctcaaggagagaaccctgattgacatgtacgtggaggggacactggatctgctggaactgcttatcatgcatcctttcttaaaaccagatgatcagcaaaaggaagtggttaacatggcccagaaggctataattagatactttcctgtgtttgaaaagattttaaggggtcacggacaaagctttcttgttggtaatcagctgagccttgcagatgtgattttactccaaaccattttagctctagaagagaaaattcctaatatcctgtctgcatttcctttcctccaggaatacacagtgaaactaagtaatatccctacaattaagagattccttgaacctggcagcaagaagaagcctccccctgatgaaatttatgtgagaaccgtctacaacatctttaggccataaaacaacacatccatgtgtgagtgacagtgtgttcctagagatggtattgtctacagtcatgtcttaatggatcccagctctgtcatggtgctatctatgtattaagttgggtcctaagttgggtcttttgtgtcaaagagatcatctcttctagaaatatcaaccttttttgtccagtaaataattgttaggggatctttattggaaaacttttttggagaggctggtatttaagttagatctgattgggctactcatgtcctgtagccagttcatcctcataataagaatgggcaggatctcttgttctctcctgagtgtctttctactctcctgagcgtctttctgctctccttatcctgttctcttatccttatcccctccagtctctgcctaatttttagtgtttaataacaaccgaatgtctagtaaatgactctcctctgagctgtaataaataaaatggtagtaatgaatgcaatcagtgttagccaaaataaagaatttatgagtcattgctca

SEQ ID NO: 436952 - DNA, 1292 bp, Homo sapiens
agcggagtctccattggtgaggtcgtcccggagcctcgcccagctcccgcgcgctagagccgcctgctggtctcacccagccgggaccgctgacctggcgctttgtgcggctccaggcctccgagtggactccagaaagcctgaaaagctatcatggcagcaaggcccaagctccactatcccaacggaagaggccggatggagtccgtgagatgggttttagctgccgccggagtcgaggtaaccacctgctgttccaacaagtgcccatggttgaaattgacgggatgaagttggtacagacccgaagcattctccactacatagcagacaagcacaatctctttggcaagaacctcaaggagagaaccctgattgacatgtacgtggaggggacactggatctgctggaactgcttatcatgcatcctttcttaaaaccagatgatcagcaaaaggaagtggttaacatggcccagaaggctataattagatactttcctgtgtttgaaaagattttaaggggtcacggacaaagctttcttgttggtaatcagctgagccttgcagatgtgattttactccaaaccattttagctctagaagagaaaattcctaatatcctgtctgcatttcctttcctccaggaatacacagtgaaactaagtaatatccctacaattaagagattccttgaacctggcagcaagaagaagcctccccctgatgaaatttatgtgagaaccgtctacaacatctttaggccataaaacaacacatccatgtgtgagtgacagtgtgttcctagagatggtattgtctacagtcatgtcttaatggatcccagctctgtcatggtgctatctatgtattaagttgggtcctaagttgggtcttttgtgtcaaagagatcatctcttctagaaatatcaaccttttttgtccagtaaataattgttaggggatctttattggaaaacttttttggagaggctggtatttaagttagatctgattgggctactcatgtcctgtagccagttcatcctcataataagaatgggcaggatctcttgttctctcctgagtgtctttctactctcctgagcgtctttctgctctccttatcctgttctcttatccttatcccctccagtctctgcctaatttttagtgtttaataacaaccgaatgtctagtaaatgactctcctctgagctgtaataaataaaatggtagtaatgaatgcaatcagtgttagccaaaataaagaatttatgagtcattgctca

SEQ ID NO: 436953 - DNA, 1432 bp, Homo sapiens
agcggagtctccattggtgaggtcgtcccggagcctcgcccagctcccgcgcgctagagccgcctgctggtctcacccagccgggaccgctgacctggcgctttgtgcggctccaggcctccgagtggactccagtgagggaaaatgcagcaacaaaaataaagaacagtttcccgtgccaaaatcctgaatattcatttcgcccctgagcactgggttgaagacgcgaaattgggactgttggtctgcgacgagctgctgcatttgtatttcagaaagcctgaaaagctatcatggcagcaaggcccaagctccactatcccaacggaagaggccggatggagtccgtgagatgggttttagctgccgccggagtcgaggtaaccacctgctgttccaacaagtgcccatggttgaaattgacgggatgaagttggtacagacccgaagcattctccactacatagcagacaagcacaatctctttggcaagaacctcaaggagagaaccctgattgacatgtacgtggaggggacactggatctgctggaactgcttatcatgcatcctttcttaaaaccagatgatcagcaaaaggaagtggttaacatggcccagaaggctataattagatactttcctgtgtttgaaaagattttaaggggtcacggacaaagctttcttgttggtaatcagctgagccttgcagatgtgattttactccaaaccattttagctctagaagagaaaattcctaatatcctgtctgcatttcctttcctccaggaatacacagtgaaactaagtaatatccctacaattaagagattccttgaacctggcagcaagaagaagcctccccctgatgaaatttatgtgagaaccgtctacaacatctttaggccataaaacaacacatccatgtgtgagtgacagtgtgttcctagagatggtattgtctacagtcatgtcttaatggatcccagctctgtcatggtgctatctatgtattaagttgggtcctaagttgggtcttttgtgtcaaagagatcatctcttctagaaatatcaaccttttttgtccagtaaataattgttaggggatctttattggaaaacttttttggagaggctggtatttaagttagatctgattgggctactcatgtcctgtagccagttcatcctcataataagaatgggcaggatctcttgttctctcctgagtgtctttctactctcctgagcgtctttctgctctccttatcctgttctcttatccttatcccctccagtctctgcctaatttttagtgtttaataacaaccgaatgtctagtaaatgactctcctctgagctgtaataaataaaatggtagtaatgaatgcaatcagtgttagccaaaataaagaatttatgagtcattgctca

SEQ ID NO: 436954 - DNA, 1276 bp, Homo sapiens
agcggagtctccattggtgaggtcgtcccggagcctcgcccagctcccgcgcgctagagccgcctgctggtctcacccagccgggaccgctgacctggcgctttgtgcggctccaggcctccgagtggactccagaaagcctgaaaagctatcatggcagcaaggcccaagctccactatcccaacggaagaggccggatggagtccgtgagatgggttttagctgccgccggagtcgagtttgatgaagaatttctggaaacaaaagaacagttgtacaagttgcaggatggtaaccacctgctgttccaacaagtgcccatggttgaaattgacgggatgaagttggtacagacccgaagcattctccactacatagcagacaagcacaatctctttggcaagaacctcaaggagagaaccctcagatgatcagcaaaaggaagtggttaacatggcccagaaggctataattagatactttcctgtgtttgaaaagattttaaggggtcacggacaaagctttcttgttggtaatcagctgagccttgcagatgtgattttactccaaaccattttagctctagaagagaaaattcctaatatcctgtctgcatttcctttcctccaggaatacacagtgaaactaagtaatatccctacaattaagagattccttgaacctggcagcaagaagaagcctccccctgatgaaatttatgtgagaaccgtctacaacatctttaggccataaaacaacacatccatgtgtgagtgacagtgtgttcctagagatggtattgtctacagtcatgtcttaatggatcccagctctgtcatggtgctatctatgtattaagttgggtcctaagttgggtcttttgtgtcaaagagatcatctcttctagaaatatcaaccttttttgtccagtaaataattgttaggggatctttattggaaaacttttttggagaggctggtatttaagttagatctgattgggctactcatgtcctgtagccagttcatcctcataataagaatgggcaggatctcttgttctctcctgagtgtctttctactctcctgagcgtctttctgctctccttatcctgttctcttatccttatcccctccagtctctgcctaatttttagtgtttaataacaaccgaatgtctagtaaatgactctcctctgagctgtaataaataaaatggtagtaatgaatgcaatcagtgttagccaaaataaagaatttatgagtcattgctca

SEQ ID NO: 436955 - DNA, 1211 bp, Homo sapiens
agcggagtctccattggtgaggtcgtcccggagcctcgcccagctcccgcgcgctagagccgcctgctggtctcacccagccgggaccgctgacctggcgctttgtgcggctccaggcctccgagtggactccagaaagcctgaaaagctatcatggcagcaaggcccaagctccactatcccaacggaagaggccggatggagtccgtgagatgggttttagctgccgccggagtcgagtttgatgaagaatttctggaaacaaaagaacagttgtacaagttgcaggatggattgacatgtacgtggaggggacactggatctgctggaactgcttatcatgcatcctttcttaaaaccagatgatcagcaaaaggaagtggttaacatggcccagaaggctataattagatactttcctgtgtttgaaaagattttaaggggtcacggacaaagctttcttgttggtaatcagctgagccttgcagatgtgattttactccaaaccattttagctctagaagagaaaattcctaatatcctgtctgcatttcctttcctccaggaatacacagtgaaactaagtaatatccctacaattaagagattccttgaacctggcagcaagaagaagcctccccctgatgaaatttatgtgagaaccgtctacaacatctttaggccataaaacaacacatccatgtgtgagtgacagtgtgttcctagagatggtattgtctacagtcatgtcttaatggatcccagctctgtcatggtgctatctatgtattaagttgggtcctaagttgggtcttttgtgtcaaagagatcatctcttctagaaatatcaaccttttttgtccagtaaataattgttaggggatctttattggaaaacttttttggagaggctggtatttaagttagatctgattgggctactcatgtcctgtagccagttcatcctcataataagaatgggcaggatctcttgttctctcctgagtgtctttctactctcctgagcgtctttctgctctccttatcctgttctcttatccttatcccctccagtctctgcctaatttttagtgtttaataacaaccgaatgtctagtaaatgactctcctctgagctgtaataaataaaatggtagtaatgaatgcaatcagtgttagccaaaataaagaatttatgagtcattgctca

SEQ ID NO: 436956 - DNA, 1306 bp, Homo sapiens
agcggagtctccattggtgaggtcgtcccggagcctcgcccagctcccgcgcgctagagccgcctgctggtctcacccagccgggaccgctgacctggcgctttgtgcggctccaggcctccgagtggactccagaaagcctgaaaagctatcatggcagcaaggcccaagctccactatcccaacggaagaggccggatggagtccgtgagatgggttttagctgccgccggagtcgagtttgatgaagaatttctggaaacaaaagaacagttgtacaagttgcaggatggtaaccacctgctgttccaacaagtgcccatggttgaaattgacgggatgaagttggtacagacccgaagcattctccactacatagcagacaagcacaatctctttggcaagaacctcaaggagagaaccctgattgacatgtacgtggaggggacactggatctgctggaactgcttatcatgcatcctttcttaaaaccagatgatcagcaaaaggaagtggttaacatggcccagaaggctataattagatactttcctgtgtttgaaaagattttaaggggtcacggacaaagctttcttgttggtaatcagctgagccttgcagatgtgattttactccaaaccattttagctctagaagagagaatacacagtgaaactaagtaatatccctacaattaagagattccttgaacctggcagcaagaagaagcctccccctgatgaaatttatgtgagaaccgtctacaacatctttaggccataaaacaacacatccatgtgtgagtgacagtgtgttcctagagatggtattgtctacagtcatgtcttaatggatcccagctctgtcatggtgctatctatgtattaagttgggtcctaagttgggtcttttgtgtcaaagagatcatctcttctagaaatatcaaccttttttgtccagtaaataattgttaggggatctttattggaaaacttttttggagaggctggtatttaagttagatctgattgggctactcatgtcctgtagccagttcatcctcataataagaatgggcaggatctcttgttctctcctgagtgtctttctactctcctgagcgtctttctgctctccttatcctgttctcttatccttatcccctccagtctctgcctaatttttagtgtttaataacaaccgaatgtctagtaaatgactctcctctgagctgtaataaataaaatggtagtaatgaatgcaatcagtgttagccaaaataaagaatttatgagtcattgctca

SEQ ID NO: 436957 - DNA, 2536 bp, Homo sapiens
agcggagtctccattggtgaggtcgtcccggagcctcgcccagctcccgcgcgctagagccgcctgctggtctcacccagccgggaccgctgacctggcgctttgtgcggctccaggcctccgagtggactccagaaagcctgaaaagctatcatggcagcaaggcccaagctccactatcccaacggaagaggccggatggagtccgtgagatgggttttagctgccgccggagtcgagtttgatgaagaatttctggaaacaaaagaacagttgtacaagttgcaggatggtaaccacctgctgttccaacaagtgcccatggttgaaattgacgggatgaagttggtacagacccgaagcattctccactacatagcagacaagcacaatctctttggcaagaacctcaaggagagaaccctgtactgtggcccctctcgagtgttgtcacttgtcagcttactgatgccttagctgattagcaacctctgtagcacaccacatttactttatgtcttacatagttagtgagatcagggaacaaaaacccaagaaggtcacgaagaccagttggaacttcagtagagagagtctgagttcagatttcaacatttttaaatgctttgatactgctttttccctttcttgcacattcactattgttaagtattaggaatgaggagctgctgtgacattcaaggcctgggagagtgagcattagattataatttgaaatcaaagcctggtccttgcaccccttagatgtatgaccctgggcaacgtgggtataagaatagtacatttctcatagtgtcatgtgatttaatgagataatggatagagagtgtttagcaccatgcctggtacactctaagcactcaataagtggtattcactatttttataaagttgaagtttgacccatacgaagagaccaaaacatggatgctggggtaaaagtggaggagtaggatgccaggagagagagcactcatgactgtcaagctgtctgatctgtgacagatttttctgagttacaactagaattgaccttatatctttgctcttaagagacaggtataggtaaatgcttctagggacttaagttgcagcatctttaaaaaaaaaaaaaaaagcactctgaattcttagttgtggaaactgatggcttcaaagagaggagaaactgagacaactgcttttttgttttaaggattgacatgtacgtggaggggacactggatctgctggaactgcttatcatgcatcctttcttaaaaccagatgatcagcaaaaggaagtggttaacatggcccagaaggctataattagatactttcctgtgtttgaaaagggtaggtggcagagatgcctacatacacagagcaaccaaaccacaaaccacaaagaagctgccacaaacacccttttctgtccaaggattttaaaactgagcccagttgaactaacataagcgctaatggactcctaagagcgaatagtagccacagcacaaagctggtgtcttagagccccttggactctgctaggaccacatgattcagaagtctagaaaaagtatgggctccctgcctttgttccttattgttccttgcattcaccaagttcccaccttgtgtggatacagcagaaacttcagaagatacagaaaacaaaaactacctcattcattcattcaacaaaagttgtcaaacagctgtctcatagctgacatcctccctgataatttgatatgagtagaagaaccatttccattttatttatcttccctttgctctttttgtttttggttttgttgtttttctcttcttgttatatctgcttttctgagcttcaaattctttattcctgaactgggaggaacttttttagtgtttcaatgcaaacactaaagaagagggtgtgaaaatatgggaagacctatttggcaagcttcctctgaccatctttatggaactagatttaggaaaaaggagaggtattttctggggtttctgtagctaggttttatggtatctttcccacaggcactttgtgaatgtaaaataggataatgaagaaatgtggtctggaacgggcacagaggacctggtgctttggcaaaggttcactgctcattcttaggtcccaagggcccagactgtgtcagggtttcttgcaacacgcctatgaggtgagaaccgttgtcccttttacacataatgaaatgaagtcatgaagagattcagtgacctgtccaaggtaacatggccagaaaatggagagcagggttggaactctggcctctgactacaaattcaggatgcattgtactatgccactctggctccagtagctatatttgacctggaattgtgttcggagtccctgtgacacacacacttgtgcacatgcagacacccatgggcatccaagagttgactgtgaaggggatctcccctttgctactactgcttcttgcctctccctaatcacaatctattcttataagccccacacctatacgttacc

SEQ ID NO: 436958 - DNA, 1668 bp, Homo sapiens
agcggagtctccattggtgaggtcgtcccggagcctcgcccagctcccgcgcgctagagccgcctgctggtctcacccagccgggaccgctgacctggcgctttgtgcggctccaggcctccgagtggactccagaaagcctgaaaagctatcatggcagcaaggcccaagctccactatcccaacggaagaggccggatggagtccgtgagatgggttttagctgccgccggagtcgagtttgatgaagaatttctggaaacaaaagaacagttgtacaagttgcaggatggtaaccacctgctgttccaacaagtgcccatggttgaaattgacgggatgaagttggattgacatgtacgtggaggggacactggatctgctggaactgcttatcatgcatcctttcttaaaaccagatgatcagcaaaaggaagtggttaacatggcccagaaggctataattagatactttcctgtgtttgaaaagggtaggtggcagagatgcctacatacacagagcaaccaaaccacaaaccacaaagaagctgccacaaacacccttttctgtccaaggattttaaaactgagcccagttgaactaacataagcgctaatggactcctaagagcgaatagtagccacagcacaaagctggtgtcttagagccccttggactctgctaggaccacatgattcagaagtctagaaaaagtatgggctccctgcctttgttccttattgttccttgcattcaccaagttcccaccttgtgtggatacagcagaaacttcagaagatacagaaaacaaaaactacctcattcattcattcaacaaaagttgtcaaacagctgtctcatagctgacatcctccctgataatttgatatgagtagaagaaccatttccattttatttatcttccctttgctctttttgtttttggttttgttgtttttctcttcttgttatatctgcttttctgagcttcaaattctttattcctgaactgggaggaacttttttagtgtttcaatgcaaacactaaagaagagggtgtgaaaatatgggaagacctatttggcaagcttcctctgaccatctttatggaactagatttaggaaaaaggagaggtattttctggggtttctgtagctaggttttatggtatctttcccacaggcactttgtgaatgtaaaataggataatgaagaaatgtggtctggaacgggcacagaggacctggtgctttggcaaaggttcactgctcattcttaggtcccaagggcccagactgtgtcagggtttcttgcaacacgcctatgaggtgagaaccgttgtcccttttacacataatgaaatgaagtcatgaagagattcagtgacctgtccaaggtaacatggccagaaaatggagagcagggttggaactctggcctctgactacaaattcaggatgcattgtactatgccactctggctccagtagctatatttgacctggaattgtgttcggagtccctgtgacacacacacttgtgcacatgcagacacccatgggcatccaagagttgactgtgaaggggatctcccctttgctactactgcttcttgcctctccctaatcacaatctattcttataagccccacacctatacgttacc

SEQ ID NO: 436959 - DNA, 1354 bp, Homo sapiens
agcggagtctccattggtgaggtcgtcccggagcctcgcccagctcccgcgcgctagagccgcctgctggtctcacccagccgggaccgctgacctggcgctttgtgcggctccaggcctccgagtggactccagaaagcctgaaaagctatcatggcagcaaggcccaagctccactatcccaacggaagaggccggatggagtccgtgagatgggttttagctgccgccggagtcgaggtaccttatatgctgtttcttcacggatttgtcatacagcttttgagacctttgaaagaaaaatacgttttgaagcaccgttcagttctagttctcgtccaccaaaatcacaggcacgcttcactgagtcagataccatccctgaagggatttttctttataattagaacgtagttgatggaattctattttccttttgacttttacttaattattggcttctgatctagcaccagtgaatatttattaataagaagaaaggaaatttacctgaaaattgtcagttactctgagctcttattaattatgcattctcagggtaaatttcttgttttcttcagtggcttcaaactggcagccttggtatcttgcttacatatgtgtgtgtgtctgtttttgttttcgttctgttcttttagcttcttagtatggaaattttcaaataccaataaatgtagagagaacattgccatgaattctatgtactcatcacccgacttcagcaatcatcagctctatgctaatcttgtttcatctatcacctcccttcccttgttttgtgggagtattttaaagcaaaatccaaacatcataacatttcatctgggagttcctcaacattttcctctaacagatgaggattttaaaatgtaacaatattattatcacatccaacaaaattagcaattctttgtcatctaaccttcagtctgattgtctcaaacaggcattttgtttgtttgtttgtttttatagtttgttttagtttggatctagacattggtctacgcattacatttaaaatggttatgtttctttcggtattttaaaaacctgtaagtttcctcttcattttttacaaatttatatttgggaatattttcagatttatagaaaagttgtaaaataatacagtccctcattcagtctcccttaatgataacatcttacatcaccatgtcatattacgaaattaacattggtgcatgactaactaaactacagactttattcagatttcactgttttttctactaatgttctgggtttttttttgacggaggctggctctcactgcattccagcctggacaacagaacgagactccatctca

SEQ ID NO: 436960 - DNA, 2452 bp, Homo sapiens
gcggccgcgggcgcccctgccctgagcccaccccgcgctctgccctccctaacaatgggaatggggcagaaggaggcgccccactgcggggaggtgaggggtgggtttgggactggggtccgcggtggggggaggtgcgatctcgggctctcgcctctccgctccctctggctctggagttgggggcccctgtggggctctgaagtccgcctgagacttgggtcaagagtcaaactgtcgccccccgctcctcccccaaaatccggtgagcggtaaggaaagtgatgccaagtcttcgaagcctcagtgacaaacgcatagcaagaacacatccactccagagataccttctcgaaacaaaagattttcctacctgcttatacttggtaaccgagggaattactaagacttcttgctcatttctgagtattgtctttatatcctgacactatgaatgctacttggatgcctcttaagtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcctctgtcaattccatggaacagccggcacttcaaggaagcagtagattatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttccagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgtgagtagacctcatgcatgatagcattcttgagaaatgttggcacaaggaagaatgaatgaatcgccattatggagagaatgtgattctttgtacataggtgtctaggttctgtttgttttttccctgatgttgggtagatgagtgcatatacatgctagtgaagaaggggaagatacttttgctgtagggttgtattgttgtagtctaaatggtggtaatttccttttgaagtctaagaaaaataactaggagacatcttatgtgtaaaattgtactagtacctctttaagagtgaatttagatttcttttgaaactatatataggacatgataagttaatggcctgattgttgagattttgttgtttccagtaagcagggacaaatgctgagttgacctagttacctttgtaggaaattacagttgcttttgattgaactttcagcagagagcacacccagtcttcaattttaacacttgagattttcttacattttaaggactgacaattagaaaatgcttcagaatatttaatacatcgcctccaagcacagtctagtttcacaacctgactctcttcctattaaaaaaaa

SEQ ID NO: 436961 - DNA, 2388 bp, Homo sapiens
  misc_feature (2367)..(2368): n is a, c, g, or t
gcggccgcgggcgcccctgccctgagcccaccccgcgctctgccctccctaacaatgggaatggggcagaaggaggcgccccactgcggggaggtgaggggtgggtttgggactggggtccgcggtggggggaggtgcgatctcgggctctcgcctctccgctccctctggctctggagttgggggcccctgtggggctctgaagtccgcctgagacttgggtcaagagtcaaactgtcgccccccgctcctcccccaaaatccggtgagcggtaaggaaagtgatgccaagtcttcgaagcctcagtgacaaacgcatagcaagaacacatccactccagagataccttctcgaaacaaaagattttcctacctgcttatacttggtaaccgagggaattactaagacttcttgctcatttctgagtattgtctttatatcctgacactatgaatgctacttggatgcctcttaagtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcctctgtcaattccatggaacagccggcacttcaaggaagcagtagattatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttccagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgtatctccatacagccaagaataaagaaagaaagggatagatggaatgagtttcatcgtgattgggagcggttgttgagaagaatcatgtaactatgtaaaaagcatgtctgtttggtacactatttgctaatgtcagaagtgttaaatagaaataaaatttccaccatagtagctaattattgtttagtgtgtgtcaaaactgtgtgctaattactttttataaaccgtcgcctttaaagtcttataacttttctatgaagtaggacgtttgtgtccctacctcctctgttttaccattgggaaaaccagggcccagaacgagtaaccacacaagttccacagctaccaaggtcaaggttatttctaccctaaatacacatctttaaattttatattcatccacaaagtcacgagcagcatctgtatttcgttaggaaaagtagcactaaacatcatgatgtgatgaatgcccttcagtggcatagtatcttttcagtataagatgtatnngaggtccaatcccatagtac

SEQ ID NO: 436962 - DNA, 2360 bp, Homo sapiens
taattattgcttagtttgatgtgtcttgctttaaatccatttatttcaacaagcttaaagagatttttttttaatggagatgatttaattttaacaatctgtgattttctctgaatcgaacttgtgttttggcacctttcaatctgtggtaacaaatgacaagaagggtgcaattcttccttcccttgtgcagggattttgcctccccctttctcccagatgaaagatatttgggtctctagaataactgtggtacagttagctccagagtgttttctttctggaggcagtttagacaacagcctcaagtagtgcttttgttaaaaatatacatgtttttaaaagtgcttgtatttctaatattcttttctcctttctcttctagtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcctctgtcaattccatggaacagccggcacttcaaggaagcagtagattatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttccagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgtgagtagacctcatgcatgatagcattcttgagaaatgttggcacaaggaagaatgaatgaatcgccattatggagagaatgtgattctttgtacataggtgtctaggttctgtttgttttttccctgatgttgggtagatgagtgcatatacatgctagtgaagaaggggaagatacttttgctgtagggttgtattgttgtagtctaaatggtggtaatttccttttgaagtctaagaaaaataactaggagacatcttatgtgtaaaattgtactagtacctctttaagagtgaatttagatttcttttgaaactatatataggacatgataagttaatggcctgattgttgagattttgttgtttccagtaagcagggacaaatgctgagttgacctagttacctttgtaggaaattacagttgcttttgattgaactttcagcagagagcacacccagtcttcaattttaacacttgagattttcttacattttaaggactgacaattagaaaatgcttcagaatatttaatacatcgcctccaagcacagtctagtttcacaacctgactctcttcctattaaaaaaaa

SEQ ID NO: 436963 - DNA, 785 bp, Homo sapiens
  misc_feature (764)..(765): n is a, c, g, or t
aggcttttaattgtaagccattcagcatgtgaactcgtaaaaatgaccttatgttaaataattagttcagagcgctgatcttgagagataggaacgtttcctgtttttgataaatgataggttacccttgtttatggttaggggtgggtttttgtcatggtccaaccaggtgatagttatatatgtgaacatattaaaattgtttttaatgtttaaattctaatccttaaaatgtgacagaactgatttatgttcctcctctcccagttctcttcaaatcatgagagtgaccctcttaaaaactgctttctttcgggggagcggttgttgagaagaatcatgtaactatgtaaaaagcatgtctgtttggtacactatttgctaatgtcagaagtgttaaatagaaataaaatttccaccatagtagctaattattgtttagtgtgtgtcaaaactgtgtgctaattactttttataaaccgtcgcctttaaagtcttataacttttctatgaagtaggacgtttgtgtccctacctcctctgttttaccattgggaaaaccagggcccagaacgagtaaccacacaagttccacagctaccaaggtcaaggttatttctaccctaaatacacatctttaaattttatattcatccacaaagtcacgagcagcatctgtatttcgttaggaaaagtagcactaaacatcatgatgtgatgaatgcccttcagtggcatagtatcttttcagtataagatgtatnngaggtccaatcccatagtac

SEQ ID NO: 436964 - DNA, 1177 bp, Homo sapiens
gcggccgcgggcgcccctgccctgagcccaccccgcgctctgccctccctaacaatgggaatggggcagaaggaggcgccccactgcggggaggtgaggggtgggtttgggactggggtccgcggtggggggaggtgcgatctcgggctctcgcctctccgctccctctggctctggagttgggggcccctgtggggctctgaagtccgcctgagacttgggtcaagagtcaaactgtcgccccccgctcctcccccaaaatccggtgagcggtaaggaaagtgatgccaagtcttcgaagcctcagtgacaaacgcatagcaagaacacatccactccagagataccttctcgaaacaaaagattttcctacctgcttatacttggtaaccgagggaattactaagacttcttgctcatttctgagtattgtctttatatcctgacactatgaatgctacttggatgcctcttaaggggttcttcttttctgcagggcccccaatagaaattgtggctgaaggttgtgcacaaacaagtatctccagtgacaggagtgccttctgaggcagccattgcatcttcatctgctgacactctgctaggctgacttctgtagttcaacaccactgatcttcaggtccacctcacagagctctataaaacgcttaaatcctctttacatcatagactttcagctacttgaagatagccatcagccgctacgtgactctttatctccaggatctccctaatactatgaacgcggcagagataacggacaagctcggctccattcccttccgctacaggaacacggggcacatccaggcttactctgtgccacttaactggacatgggctttacgaaaggcctgaaactggctcgccaagccagtttccagaaccagaaactggctcagccggattctattctttgtgccttggtggacacatcaaactagccctcgggtgtggtgccgtgtacgtgtgtgccggcacttgccggcagtctctcaaacgtggcctaatcattgcgtaagcaaaccgtggttcatcttactgacacccgtgctcgtttaccccacccgcactcaaacagattggagatctatctcgcctctccggcaaactaagcggcttgtgtcaagacaacggctctgctcgcattccgcga

SEQ ID NO: 436965 - DNA, 1546 bp, Homo sapiens
  misc_feature (1520)..(1520): n is a, c, g, or t
gcggccgcgggcgcccctgccctgagcccaccccgcgctctgccctccctaacaatgggaatggggcagaaggaggcgccccactgcggggaggtgaggggtgggtttgggactggggtccgcggtggggggaggtgcgatctcgggctctcgcctctccgctccctctggctctggagttgggggcccctgtggggctctgaagtccgcctgagacttgggtcaagagtcaaactgtcgccccccgctcctcccccaaaatccggtgagcggtaaggaaagtgatgccaagtcttcgaagcctcagtgacaaacgcatagcaagaacacatccactccagagataccttctcgaaacaaaagattttcctacctgcttatacttggtaaccgagggaattactaagacttcttgctcatttctgagtattgtctttatatcctgacactatgaatgctacttggatgcctcttaagtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcctctgtcaattccatggaacagccggcacttcaaggaagcagtagattatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgctcaaagtcttctccaaaaatccacccagctnatgttgtatatgcctctcaacctgct

SEQ ID NO: 436966 - DNA, 1341 bp, Homo sapiens
cggtgttatcgatgccaccgcagccatggctcgggtggtcccaagaactctgaagcgggtggcagctccaaagcatggatgctggataaatgaccggtgtgttgctcctcgtccatccaccggtccccacaagtgagagagtgtctccccctcatcattttccatggaacagccggcacttcaaggaagcagtagattatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttccagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgtgagtagacctcatgcatgatagcattcttgagaaatgttggcacaaggaagaatgaatgaatcgccattatggagagaatgtgattctttgtacataggtgtctaggttctgtttgttttttccctgatgttgggtagatgagtgcatatacatgctagtgaagaaggggaagatacttttgctgtagggttgtattgttgtagtctaaatggtggtaatttccttttgaagtctaagaaaaataactaggagacatcttatgtgtaaaattgtactagtacctctttaagagtgaatttagatttcttttgaaactatatataggacatgataagttaatggcctgattgttgagattttgttgtttccagtaagcagggacaaatgctgagttgacctagttacctttgtaggaaattacagttgcttttgattgaactttcagcagagagcacacccagtcttcaattttaacacttgagattttcttacattttaaggactgacaattagaaaatgcttcagaatatttaatacatcgcctccaagcacagtctagtttcacaacctgactctcttcctattaaaaaaaa

SEQ ID NO: 436967 - DNA, 712 bp, Homo sapiens
ccaaggggtctttgagtttaccccccccccccgggtatgggatatcgtcgaccacgccgtcgcagtttcacatcagtctctccagatagcactacgatgtattccgcttctgaacaggatcccatgccagtgtggaacaccttcccaatcttagttcagaagtggcttgtatgacctgttcaggggtcacatgaggtctcgccagtttcctgggtcctcttcagaggccagaaagttctaagttctgagtccccggccagggtcccttaacacctcggcacagaggctgttggcaagtgtagaggctgcctctgtgtgtggtttaagtaaactggaaatgagacattgacgtgctgctcctccagaggtctgcacactccacttcacatgccgttgactctcacagtctaagacttcagggccgggacctttgtccagcctgcacagtagagtgaggctgcctctcccgccaggcattgggatcccatttagaaacggcattcacttcagaaggtactttttaactgctcagtttttgactattttaaatagtttgctgaaaactcctgataacacttgctacatatcatgttttaattgcttgtacagttaacctttaattttatttagtaaagtgtatcaaagtaggacttttttgaattgtaaataggtggttttattaaataaaagtcaatgtaaaattgttaaaaaa

SEQ ID NO: 436968 - DNA, 2618 bp, Homo sapiens
tttgattcctaacactggagttggccttaaacaaaacaaacacaaaaacttttaaagaattaaaccaaggcttagccttaagcagctcagtggaaggatgagctgctgcggaccacagccagccactgcatctgctgcacagttgaacgatgggcagtggctcacccccactcctttatttcagcaaaagctaattaaattgtaatgtttctatgtcaactactgggaagtatgttacagtcttagccaggatgcatgagagatgttatttgggagacttgagatgctttggctgatatttacatgttttcgataagaaagggatcgctgattgagttattgagatagtttttccagagctggaggtcacgtttctaaaactcacctacgaaagatagcattaaaggaacaggggctctctgaggatggccactgatgtgtgtttgtggatacctgggcatcgacccagcctgcaggtgagctctgggccatgttgccttgacacagtcacagtgtagaggctgcaggtgcacacgtgggctccagtgggactgcgctctgggagactgctccctggcatcggtcctgcggaggtggaaagttcgagaggaggagctatttgcgaggaagccctgtggcaatagagataggcttaaaagcggagagaacacagagtggaatcagccccctgtaagtaaaagggtagagaaagagatgtgtggctgggccctctcccacctgcctgttcagtggaggccaggcagcagcccagaacagcacatgtgggggaggtggccccttgtgccagcagtggctcctctctgcctttgagccctgcacagctggacccatcctaagtgccagtgagtccctcacacatttgactttagaacgtgtgcttcatgacccgttgtacagacggaggagcgagcaacacacgtctaacagcctagacaatctcgtcagatgctcatactggaccatcagcctccccattttagctgactttcccagggtcgttggcaaattttttgttctgtcttttccttgactaattgtagaactttgtgtgaggactttggttatccaaaatcacagaaatgaaccgttttgcagctgcgcagtctaaagggcaggccagtgtctggaagcagggcccacgtggcggtccgctggcaggctggtcctggggagcattctgcggacccggtcacgggcttggttagtcatgcgtacatgtgtgccttggggtgctctgcactccacggcccttctcagccacacttcccaccccagggggtgcccccaggctgatctcatttctgatgttgagggctgtttggctctgtctgtatagcttgtaacaggagccttgggctaggggctggggaaggaaagccgagctggcattcgttctctggactttttatgcctgccatacccgctaatgctcctcgaggtgcaggagcaggttgctgagccagtggctgccccgtgccctccttcccagcactatcatgtgtcacgtttcccggactctgcccctacatctcagctgaatctccagggaggctgcagagcatcgtggagaccactttctgcctcggcctttaaatgctgactcacctcctctcggaggaggcgtcctgtcttcacgggggggtcccggtggcctccagacgtagccatttcctgacatcaagatgttgaatgtaatctggtctgagctgggcctgtgggaggggccgcctgaggcctgtgcgctgttgtcctcgcagatgtacttatttttgttcatgatacgggcgttccgttccttaaagatgtatatattttcttactgtacataaagatgttccttaagtcgtacagaaggtggcgcggcaaagggcctcgtgcagtgtgttcagattgcccctggggatcttctgtgtcttcagcgcccagccctgcgtgttcctggtgaagcagtttcacatcagtctctccagatagcactacgatgtattccgcttctgaacaggatcccatgccagtgtggaacaccttcccaatcttagttcagaagtggcttgtatgacctgttcaggggtcacatgaggtctcgccagtttcctgggtcctcttcagaggccagaaagttctaagttctgagtccccggccagggtcccttaacacctcggcacagaggctgttggcaagtgtagaggctgcctctgtgtgtggtttaagtaaactggaaatgagacattgacgtgctgctcctccagaggtctgcacactccacttcacatgccgttgactctcacagtctaagacttcagggccgggacctttgtccagcctgcacagtagagtgaggctgcctctcccgccaggcattgggatcccatttagaaacggcattcacttcagaaggtactttttaactgctcagtttttgactattttaaatagtttgctgaaaactcctgataacacttgctacatatcatgttttaattgcttgtacagttaacctttaattttatttagtaaagtgtatcaaagtaggacttttttgaattgtaaataggtggttttattaaataaaagtcaatgtaaaattgttaaaaaa

SEQ ID NO: 436969 - DNA, 1296 bp, Homo sapiens
tttgattcctaacactggagttggccttaaacaaaacaaacacaaaaacttttaaagaattaaaccaaggcttagccttaagcagctcagtggaaggatgagctgctgcggaccacagccagccactgcatctgctgcacagttgaacgatgggcagtggctcacccccactcctttatttcagcaaaagctaattaaattgtaatgtttctatgtcaactactgggaagtatgttacagtcttagccaggatgcatgagagatgttatttgggagacttgagatgctttggctgatatttacatgttttcgataagaaagggatcgctgattgagttattgagatagtttctccagacgtagccatttcctgacatcaagatgttgaatgtaatctggtctgagctgggcctgtgggaggggccgcctgaggcctgtgcgctgttgtcctcgcagatgtacttatttttgttcatgatacgggcgttccgttccttaaagatgtatatattttcttactgtacataaagatgttccttaagtcgtacagaaggtggcgcggcaaagggcctcgtgcagtgtgttcagattgcccctggggatcttctgtgtcttcagcgcccagccctgcgtgttcctggtgaagcagtttcacatcagtctctccagatagcactacgatgtattccgcttctgaacaggatcccatgccagtgtggaacaccttcccaatcttagttcagaagtggcttgtatgacctgttcaggggtcacatgaggtctcgccagtttcctgggtcctcttcagaggccagaaagttctaagttctgagtccccggccagggtcccttaacacctcggcacagaggctgttggcaagtgtagaggctgcctctgtgtgtggtttaagtaaactggaaatgagacattgacgtgctgctcctccagaggtctgcacactccacttcacatgccgttgactctcacagtctaagacttcagggccgggacctttgtccagcctgcacagtagagtgaggctgcctctcccgccaggcattgggatcccatttagaaacggcattcacttcagaaggtactttttaactgctcagtttttgactattttaaatagtttgctgaaaactcctgataacacttgctacatatcatgttttaattgcttgtacagttaacctttaattttatttagtaaagtgtatcaaagtaggacttttttgaattgtaaataggtggttttattaaataaaagtcaatgtaaaattgttaaaaaa

SEQ ID NO: 436970 - DNA, 1029 bp, Homo sapiens
cagggacccgctttattgaacccgagactttcttgggggaggtgacacaccctacaccgatttccatcgtgcgcaacgcgctgagcacgtccatggcccggttctaggtgcgacagatacatgctgactcacctcctctcggaggaggcgtcctgtcttcacgaggcctgtgcgctgttgtcctcgcagatgtacttatttttgttcatgatacgggcgttccgttccttaaagatgtatatattttcttactgtacataaagatgttccttaagtcgtacagaaggtggcgcggcaaagggcctcgtgcagtgtgttcagattgcccctggggatcttctgtgtcttcagcgcccagccctgcgtgttcctggtgaagcagtttcacatcagtctctccagatagcactacgatgtattccgcttctgaacaggatcccatgccagtgtggaacaccttcccaatcttagttcagaagtggcttgtatgacctgttcaggggtcacatgaggtctcgccagtttcctgggtcctcttcagaggccagaaagttctaagttctgagtccccggccagggtcccttaacacctcggcacagaggctgttggcaagtgtagaggctgcctctgtgtgtggtttaagtaaactggaaatgagacattgacgtgctgctcctccagaggtctgcacactccacttcacatgccgttgactctcacagtctaagacttcagggccgggacctttgtccagcctgcacagtagagtgaggctgcctctcccgccaggcattgggatcccatttagaaacggcattcacttcagaaggtactttttaactgctcagtttttgactattttaaatagtttgctgaaaactcctgataacacttgctacatatcatgttttaattgcttgtacagttaacctttaattttatttagtaaagtgtatcaaagtaggacttttttgaattgtaaataggtggttttattaaataaaagtcaatgtaaaattgttaaaaaa

SEQ ID NO: 436971 - DNA, 3855 bp, Homo sapiens
ctctcccaaccgcctcgtcgcactcctcaggctgagagcaccgctgcactcgcggccggcgatgcgggaccccggcgcggccgctccgctttcgtccctgggcctctgtgccctggtgctggcgctgctgggcgcactgtccgcgggcgccggggcgcagccgtaccacggagagaagggcatctccgtgccggaccacggcttctgccagcccatctccatcccgctgtgcacggacatcgcctacaaccagaccatcctgcccaacctgctgggccacacgaaccaagaggacgcgggcctcgaggtgcaccagttctacccgctggtgaaggtgcagtgttctcccgaactccgctttttcttatgctccatgtatgcgcccgtgtgcaccgtgctcgatcaggccatcccgccgtgtcgttctctgtgcgagcgcgcccgccagggctgcgaggcgctcatgaacaagttcggcttccagtggcccgagcggctgcgctgcgagaacttcccggtgcacggtgcgggcgagatctgcgtgggccagaacacgtcggacggctccgggggcccaggcggcggccccactgcctaccctaccgcgccctacctgccggacctgcccttcaccgcgctgcccccgggggcctcagatggcagggggcgtcccgccttccccttctcatgcccccgtcagctcaaggtgcccccgtacctgggctaccgcttcctgggtgagcgcgattgtggcgccccgtgcgaaccgggccgtgccaacggcctgatgtactttaaggaggaggagaggcgcttcgcccgcctctgggtgggcgtgtggtccgtgctgtgctgcgcctcgacgctctttaccgttctcacctacctggtggacatgcggcgcttcagctacccagagcggcccatcatcttcctgtcgggctgctacttcatggtggccgtggcgcacgtggccggcttccttctagaggaccgcgccgtgtgcgtggagcgcttctcggacgatggctaccgcacggtggcgcagggcaccaagaaggagggctgcaccatcctcttcatggtgctctacttcttcggcatggccagctccatctggtgggtcattctgtctctcacttggttcctggcggccggcatgaagtggggccacgaggccatcgaggccaactcgcagtacttccacctggccgcgtgggccgtgcccgccgtcaagaccatcactatcctggccatgggccaggtagacggggacctgctgagcggggtgtgctacgttggcctctccagtgtggacgcgctgcggggcttcgtgctggcgcctctgttcgtctacctcttcataggcacgtccttcttgctggccggcttcgtgtccctcttccgtatccgcaccatcatgaaacacgacggcaccaagaccgagaagctggagaagctcatggtgcgcatcggcgtcttcagcgtgctctacacagtgcccgccaccatcgtcctggcctgctacttctacgagcaggccttccgcgagcactgggagcgcacctggctcctgcagacgtgcaagagctatgccgtgccctgcccgcccggccacttcccgcccatgagccccgacttcaccgtcttcatgatcaagtacctgatgaccatgatcgtcggcatcaccactggcttctggatctggtcgggcaagaccctgcagtcgtggcgccgcttctaccacagacttagccacagcagcaagggggagactgcggtatgagccccggcccctccccacctttcccaccccagccctcttgcaagaggagaggcacggtagggaaaagaactgctgggtgggggcctgtttctgtaactttctccccctctactgagaagtgacctggaagtgagaagttctttgcagatttggggcgaggggtgatttggaaaagaagacctgggtggaaagcggtttggatgaaaagatttcaggcaaagacttgcaggaagatgatgataacggcgatgtgaatcgtcaaaggtacgggccagcttgtgcctaatagaaggttgagaccagcagagactgctgtgagtttctcccggctccgaggctgaacggggactgtgagcgatccccctgctgcagggcgagtggcctgtccagacccctgtgaggccccgggaaaggtacagccctgtctgcggtggctgctttgttggaaagagggagggcctcctgcggtgtgcttgtcaagcagtggtcaaaccataatctcttttcactggggccaaactggagcccagatgggttaatttccagggtcagacattacggtctctcctcccctgccccctcccgcctgtttttcctcccgtactgctttcaggtcttgtaaaataagcatttggaagtcttgggaggcctgcctgctagaatcctaatgtgaggatgcaaaagaaatgatgataacattttgagataaggccaaggagacgtggagtaggtatttttgctactttttcattttctggggaaggcaggaggcagaaagacgggtgttttatttggtctaataccctgaaaagaagtgatgacttgttgcttttcaaaacaggaatgcatttttccccttgtctttgttgtaagagacaaaagaggaaacaaaagtgtctccctgtggaaaggcataactgtgacgaaagcaacttttataggcaaagcagcgcaaatctgaggtttcccgttggttgttaatttggttgagataaacattcctttttaaggaaaagtgaagagcagtgtgctgtcacacaccgttaagccagaggttctgacttcgctaaaggaaatgtaagaggttttgttgtctgttttaaataaatttaattcggaacacatgatccaacagactatgttaaaatattcagggaaatctctcccttcatttactttttcttgctataagcctatatttaggtttcttttctatttttttctcccatttggatcctttgaggtaaaaaaacataatgtcttcagcctcataataaaggaaagttaattaaaaaaaaaaagcaaagagccattttgtcctgttttcttggttccatcaatctgtttattaaacatcatccatatgctgaccctgtctctgtgtggttgggttgggaggcgatcagcagataccatagtgaacgaagaggaaggtttgaaccatgggccccatctttaaagaaagtcattaaaagaaggtaaacttcaaagtgattctggagttctttgaaatgtgctggaagacttaaatttattaatcttaaatcatgtactttttttctgtaatagaactcggattcttttgcatgatggggtaaagcttagcagagaatcatgggagctaacctttatcccacctttgacactaccctccaatcttgcaacactatcctgtttctcagaacagtttttaaatgccaatcatagagggtactgtaaagtgtacaagttactttatatatgtaatgttcacttgagtggaactgctttttacattaaagttaaaatcgatcttgtgtttcttcaaccttcaaaactatctcatctgtcagatttttaaaactccaacacaggttttggcatcttttgtgctgtatcttttaagtgcatgtgaaatttgtaaaatagagataagtacagtatgtatattttgtaaatctcccatttttgtaagaaaatatatattgtatttatacatttttactttggatttttgttttgttggctttaaaggtctaccccactttatcacatgtacagatcacaaataaatttttttaaatacaaaa

SEQ ID NO: 436972 - DNA, 833 bp, Homo sapiens
cggacgcgtgggcggacgagtgggcttcagcctcataataaaggaaagttaattaaaaaaaaaaagcaaagagccattttgtcctgttttcttggttccatcaatctgtttattaaacatcatccatatgctgaccctgtctctgtgtggttgggttgggaggcgatcagcagataccatagtgaacgaagaggaaggtttgaaccatgggccccatctttaaagaaagtcattaaaagaaggtaaacttcaaagtgattctggagttctttgaaatgtgctggaagacttaaatttattaatcttaaatcatgtactttttttctgtaatagaactcggattcttttgcatgatggggtaaagcttagcagagaatcatgggagctaacctttatcccacctttgacactaccctccaatcttgcaacactatcctgtttctcagaacagtttttaaatgccaatcatagagggtactgtaaagtgtacaagttactttatatatgtaatgttcacttgagtggaactgctttttacattaaagttaaaatcgatcttgtgtttcttcaaccttcaaaactatctcatctgtcagatttttaaaactccaacacaggttttggcatcttttgtgctgtatcttttaagtgcatgtgaaatttgtaaaatagagataagtacagtatgtatattttgtaaatctcccatttttgtaagaaaatatatattgtatttatacatttttactttggatttttgttttgttggctttaaaggtctaccccactttatcacatgtacagatcacaaataaatttttttaaatacaaaa

SEQ ID NO: 436973 - DNA, 4664 bp, Homo sapiens
ctctcccaaccgcctcgtcgcactcctcaggctgagagcaccgctgcactcgcggccggcgatgcgggaccccggcgcggccgctccgctttcgtccctgggcctctgtgccctggtgctggcgctgctgggcgcactgtccgcgggcgccggggcgcagccgtaccacggagagaagggcatctccgtgccggaccacggcttctgccagcccatctccatcccgctgtgcacggacatcgcctacaaccagaccatcctgcccaacctgctgggccacacgaaccaagaggacgcgggcctcgaggtgcaccagttctacccgctggtgaaggtgcagtgttctcccgaactccgctttttcttatgctccatgtatgcgcccgtgtgcaccgtgctcgatcaggccatcccgccgtgtcgttctctgtgcgagcgcgcccgccagggctgcgaggcgctcatgaacaagttcggcttccagtggcccgagcggctgcgctgcgagaacttcccggtgcacggtgcgggcgagatctgcgtgggccagaacacgtcggacggctccgggggcccaggcggcggccccactgcctaccctaccgcgccctacctgccggacctgcccttcaccgcgctgcccccgggggcctcagatggcagggggcgtcccgccttccccttctcatgcccccgtcagctcaaggtgcccccgtacctgggctaccgcttcctgggtgagcgcgattgtggcgccccgtgcgaaccgggccgtgccaacggcctgatgtactttaaggaggaggagaggcgcttcgcccgcctctgggtgggcgtgtggtccgtgctgtgctgcgcctcgacgctctttaccgttctcacctacctggtggacatgcggcgcttcagctacccagagcggcccatcatcttcctgtcgggctgctacttcatggtggccgtggcgcacgtggccggcttccttctagaggaccgcgccgtgtgcgtggagcgcttctcggacgatggctaccgcacggtggcgcagggcaccaagaaggagggctgcaccatcctcttcatggtgctctacttcttcggcatggccagctccatctggtgggtcattctgtctctcacttggttcctggcggccggcatgaagtggggccacgaggccatcgaggccaactcgcagtacttccacctggccgcgtgggccgtgcccgccgtcaagaccatcactatcctggccatgggccaggtagacggggacctgctgagcggggtgtgctacgttggcctctccagtgtggacgcgctgcggggcttcgtgctggcgcctctgttcgtctacctcttcataggcacgtccttcttgctggccggcttcgtgtccctcttccgtatccgcaccatcatgaaacacgacggcaccaagaccgagaagctggagaagctcatggtgcgcatcggcgtcttcagcgtgctctacacagtgcccgccaccatcgtcctggcctgctacttctacgagcaggccttccgcgagcactgggagcgcacctggctcctgcagacgtgcaagagctatgccgtgccctgcccgcccggccacttcccgcccatgagccccgacttcaccgtcttcatgatcaagtacctgatgaccatgatcgtcggcatcaccactggcttctggatctggtcgggcaagaccctgcagtcgtggcgccgcttctaccacagacttagccacagcagcaagggggagactgcggtatgagccccggcccctccccacctttcccaccccagccctcttgcaagaggagaggcacggtagggaaaagaactgctgggtgggggcctgtttctgtaactttctccccctctactgagaagtgacctggaagtgagaagttctttgcagatttggggcgaggggtgatttggaaaagaagacctgggtggaaagcggtttggatgaaaagatttcaggcaaagacttgcaggaagatgatgataacggcgatgtgaatcgtcaaaggtacgggccagcttgtgcctaatagaaggttgagaccagcagagactgctgtgagtttctcccggctccgaggctgaacggggactgtgagcgatccccctgctgcagggcgagtggcctgtccagacccctgtgaggccccgggaaaggtacagccctgtctgcggtggctgctttgttggaaagagggagggcctcctgcggtgtgcttgtcaagcagtggtcaaaccataatctcttttcactggggccaaactggagcccagatgggttaatttccagggtcagacattacggtctctcctcccctgccccctcccgcctgtttttcctcccgtactgctttcaggtcttgtaaaataagcatttggaagtcttgggaggcctgcctgctagaatcctaatgtgaggatgcaaaagaaatgatgataacattttgagataaggccaaggagacgtggagtaggtatttttgctactttttcattttctggggaaggcaggaggcagaaagacgggtgttttatttggtctaataccctgaaaagaagtgatgacttgttgcttttcaaaacaggaatgcatttttccccttgtctttgttgtaagagacaaaagaggaaacaaaagtgtctccctgtggaaaggcataactgtgacgaaagcaacttttataggcaaagcagcgcaaatctgaggtttcccgttggttgttaatttggttgagataaacattcctttttaaggaaaagtgaagagcagtgtgctgtcacacaccgttaagccagaggttctgacttcgctaaaggaaatgtaagaggttttgttgtctgttttaaataaatttaattcggaacacatgatccaacagactatgttaaaatattcagggaaatctctcccttcatttactttttcttgctataagcctatatttaggtttcttttctatttttttctcccatttggatcctttgaggtaaaaaaacataatgtcttcagcctcataataaaggaaagttaattaaaaaaaaaaagcaaagagccattttgtcctgttttcttggttccatcaatctgtttattaaacatcatccatatgctgaccctgtctctgtgtggttgggttgggaggcgatcagcagataccatagtgaacgaagaggaaggtttgaaccatgggccccatctttaaagaaagtcattaaaagaaggtaaacttcaaagtgattctggagttctttgaaatgtgctggaagacttaaatttattaatcttaaatcatgtactttttttctgtaatagaactcggattcttttgcatgatggggtaaagcttagcagagaatcatgggagctaacctttatcccacctttgacactaccctccaatcttgcaacactatcctgtttctcagaacagtttttaaatgccaatcatagagggtactgtaaagtgtacaagttactttatatatgtaatgttcacttgagtggaactgctttttacattaaagttaaaatcgatcttgtgtttcttcaaccttcaaaactatctcatctgtcagatttttaaaactccaacacaggttttggcatcttttgtgctgtatcttttaagtgcatgtgaaatttgtaaaatagagataagtacagtatgtatattttgtaaatctcccatttttgtaagaaaatatatattgtatttatacatttttactttggatttttgttttgttggctttaaaggtctaccccactttatcacatgtacagatcacaaataaatttttttaaatacaaaaaaaataaaaaacaatcaaccaacaaaccaaaaacacaaccaaaaaccaacaaaaaacaaaaaaagataataatataaatgctcaatatatatttagttataaaacgagtcatctatagatcataattactagtcggtaggtgagggcgtagcttcgctgtaaagtattagttattattatgcgtatattaggagagagtggtcgataaaatagattgggtatgtagtgtgatgttagattttaattatcggtaggatttatatgtggaacgatatatagtgtgagtaagtgagtaagcagcaagagatgaatagaagtgaggtgctgaatagatacaggaatggatagatatattagaggtagtaagattgtgagcaatgagtgatttatagttgtgtgaatatgagtatatataatatatatacgagtgatggtgaggagataaatagaaatagagagaaggaataaaattgtttgtaagtgtagtactgatataagggagtgtagaggagagtggggtgcgacgagggaggaacgcgggagcggcgagagcggatacgaggagagtgtgagtggggaagaagagacaggaagaggagcggccgagaagaggagagggcggcaggggacacgcttgagtgacggggggacgaagagaagagaataagagagggaagaaggagaaggaggaagcgagaagggaggggtgagagagtgggaacgtgggcgcggtggagtggtcggagcggcgttgctgtgtgagaaggtggtagagagttgaggagagatggatcagagggtggaggagc

SEQ ID NO: 436974 - DNA, 3076 bp, Homo sapiens
ctctcccaaccgcctcgtcgcactcctcaggctgagagcaccgctgcactcgcggccggcgatgcgggaccccggcgcggccgctccgctttcgtccctgggcctctgtgccctggtgctggcgctgctgggcgcactgtccgcgggcgccggggcgcagccgtaccacggagagaagggcatctccgtgccggaccacggcttctgccagcccatctccatcccgctgtgcacggacatcgcctacaaccagaccatcctgcccaacctgctgggccacacgaaccaagaggacgcgggcctcgaggtgcaccagttctacccgctggtgaaggtgcagtgttctcccgaactccgctttttcttatgctccatgtatgcgcccgtgtgcaccgtgctcgatcaggccatcccgccgtgtcgttctctgtgcgagcgcgcccgccagggctgcgaggcgctcatgaacaagttcggcttccagtggcccgagcggctgcgctgcgagaacttcccggtgcacggtgcgggcgagatctgcgtgggccagaacacgtcggacggctccgggggcccaggcggcggccccactgcctaccctaccgcgccctacctgccggacctgcccttcaccgcgctgcccccgggggcctcagatggcagggggcgtcccgccttccccttctcatgcccccgtcagctcaaggtgcccccgtacctgggctaccgcttcctgggtgagcgcgattgtggcgccccgtgcgaaccgggccgtgccaacggcctgatgtactttaaggaggaggagaggcgcttcgcccgcctctgggtgggcgtgtggtccgtgctgtgctgcgcctcgacgctctttaccgttctcacctacctggtggacatgcggcgcttcagctacccagagcggcccatcatcttcctgtcgggctgctacttcatggtggccgtggcgcacgtggccggcttccttctagaggaccgcgccgtgtgcgtggagcgcttctcggacgatggctaccgcacggtggcgcagggcaccaagaaggagggctgcaccatcctcttcatggtgctctacttcttcggcatggccagctccatctggtgggtcattctgtctctcacttggttcctggcggccggcatgaagtggggccacgaggccatcgaggccaactcgcagtacttccacctggccgcgtgggccgtgcccgccgtcaagaccatcactatcctggccatgggccaggtagacggggacctgctgagcggggtgtgctacgttggcctctccagtgtggacgcgctgcggggcttcgtgctggcgcctctgttcgtctacctcttcataggcacgtccttcttgctggccggcttcgtgtccctcttccgtatccgcaccatcatgaaacacgacggcaccaagaccgagaagctggagaagctcatggtgcgcatcggcgtcttcagcgtgctctacacagtgcccgccaccatcgtcctggcctgctacttctacgagcaggccttccgcgagcactgggagcgcacctggctcctgcagacgtgcaagagctatgccgtgccctgcccgcccggccacttcccgcccatgagccccgacttcaccgtcttcatgatcaagtacctgatgaccatgatcgtcggcatcaccactggcttctggatctggtcgggcaagaccctgcagtcgtggcgccgcttctaccacagacttagccacagcagcaagggggagactgcggtatgagccccggcccctccccacctttcccaccccagccctcttgcaagaggagaggcacggtagggaaaagaactgctgggtgggggcctgtttctgtaactttctccccctctactgagaagtgacctggaagtgagaagttctttgcagatttggggcgaggggtgatttggaaaagaagacctgggtggaaagcggtttggatgaaaagatttcaggcaaagacttgcaggaagatgatgataacggcgatgtgaatcgtcaaaggtacgggccagcttgtgcctaatagaaggttgagaccagcagagactgctgtgagtttctcccggctccgaggctgaacggggactgtgagcgatccccctgctgcagggcgagtggcctgtccagacccctgtgaggccccgggaaaggtacagccctgtctgcggtggctgctttgttggaaagagggagggcctcctgcggtgtgcttgtcaagcagtggtcaaaccataatctcttttcactggggccaaactggagcccagatgggttaatttccagggtcagacattacggtctctcctcccctgccccctcccgcctgtttttcctcccgtactgctttcaggtcttgtaaaataagcatttggaagtcttgggaggcctgcctgctagaatcctaatgtgaggatgcaaaagaaatgatgataacattttgagataaggccaaggagacgtggagtaggtatttttgctactttttcattttctggggaaggcaggaggcagaaagacgggtgttttatttggtctaataccctgaaaagaagtgatgacttgttgcttttcaaaacaggaatgcatttttccccttgtctttgttgtaagagacaaaagaggaaacaaaagtgtctccctgtggaaaggcataactgtgacgaaagcaacttttataggcaaagcagcgcaaatctgaggtttcccgttggttgttaatttggttgagataaacattcctttttaaggaaaagtgaagagcagtgtgctgtcacacaccgttaagccagaggttctgacttcgctaaaggaaatgtaagaggttttgttgtctgttttaaataaatttaattcggaacacatgatccaacagactatgttaaaatattcagggaaatctctcccttcatttactttttcttgctataagcctatatttaggtttcttttctatttttttctcccatttggatcctttgaggtaaaaaaacataatgtcttcagcctcataataaaggaaagttaatt

SEQ ID NO: 436975 - DNA, 3932 bp, Homo sapiens
ctctcccaaccgcctcgtcgcactcctcaggctgagagcaccgctgcactcgcggccggcgatgcgggaccccggcgcggccgctccgctttcgtccctgggcctctgtgccctggtgctggcgctgctgggcgcactgtccgcgggcgccggggcgcagccgtaccacggagagaagggcatctccgtgccggaccacggcttctgccagcccatctccatcccgctgtgcacggacatcgcctacaaccagaccatcctgcccaacctgctgggccacacgaaccaagaggacgcgggcctcgaggtgcaccagttctacccgctggtgaaggtgcagtgttctcccgaactccgctttttcttatgctccatgtatgcgcccgtgtgcaccgtgctcgatcaggccatcccgccgtgtcgttctctgtgcgagcgcgcccgccagggctgcgaggcgctcatgaacaagttcggcttccagtggcccgagcggctgcgctgcgagaacttcccggtgcacggtgcgggcgagatctgcgtgggccagaacacgtcggacggctccgggggcccaggcggcggccccactgcctaccctaccgcgccctacctgccggacctgcccttcaccgcgctgcccccgggggcctcagatggcagggggcgtcccgccttccccttctcatgcccccgtcagctcaaggtgcccccgtacctgggctaccgcttcctgggtgagcgcgattgtggcgccccgtgcgaaccgggccgtgccaacggcctgatgtactttaaggaggaggagaggcgcttcgcccgcctctgggtgggcgtgtggtccgtgctgtgctgcgcctcgacgctctttaccgttctcacctacctggtggacatgcggcgcttcagctacccagagcggcccatcatcttcctgtcgggctgctacttcatggtggccgtggcgcacgtggccggcttccttctagaggaccgcgccgtgtgcgtggagcgcttctcggacgatggctaccgcacggtggcgcagggcaccaagaaggagggctgcaccatcctcttcatggtgctctacttcttcggcatggccagctccatctggtgggtcattctgtctctcacttggttcctggcggccggcatgaagtggggccacgaggccatcgaggccaactcgcagtacttccacctggccgcgtgggccgtgcccgccgtcaagaccatcactatcctggccatgggccaggtagacggggacctgctgagcggggtgtgctacgttggcctctccagtgtggacgcgctgcggggcttcgtgctggcgcctctgttcgtctacctcttcataggcacgtccttcttgctggccggcttcgtgtccctcttccgtatccgcaccatcatgaaacacgacggcaccaagaccgagaagctggagaagctcatggtgcgcatcggcgtcttcagcgtgctctacacagtgcccgccaccatcgtcctggcctgctacttctacgagcaggccttccgcgagcactgggagcgcacctggctcctgcagacgtgcaagagctatgccgtgccctgcccgcccggccacttcccgcccatgagccccgacttcaccgtcttcatgatcaagtacctgatgaccatgatcgtcggcatcaccactggcttctggatctggtcgggcaagaccctgcagtcgtggcgccgcttctaccacagacttagccacagcagcaagggggagactgcggtatgagccccggcccctccccacctttcccaccccagccctcttgcaagaggagaggcacggtagggaaaagaactgctgggtgggggcctgtttctgtaactttctccccctctactgagaagtgacctggaagtgagaagttctttgcagatttggggcgaggggtgatttggaaaagaagacctgggtggaaagcggtttggatgaaaagatttcaggcaaagacttgcaggaagatgatgataacggcgatgtgaatcgtcaaaggtacgggccagcttgtgcctaatagaaggttgagaccagcagagactgctgtgagtttctcccggctccgaggctgaacggggactgtgagcgatccccctgctgcagggcgagtggcctgtccagacccctgtgaggccccgggaaaggtacagccctgtctgcggtggctgctttgttggaaagagggagggcctcctgcggtgtgcttgtcaagcagtggtcaaaccataatctcttttcactggggccaaactggagcccagatgggttaatttccagggtcagacattacggtctctcctcccctgccccctcccgcctgtttttcctcccgtactgctttcaggtcttgtaaaataagcatttggaagtcttgggaggcctgcctgctagaatcctaatgtgaggatgcaaaagaaatgatgataacattttgagataaggccaaggagacgtggagtaggtatttttgctactttttcattttctggggaaggcaggaggcagaaagacgggtgttttatttggtctaataccctgaaaagaagtgatgacttgttgcttttcaaaacaggaatgcatttttccccttgtctttgttgtaagagacaaaagaggaaacaaaagtgtctccctgtggaaaggcataactgtgacgaaagcaacttttataggcaaagcagcgcaaatctgaggtttcccgttggttgttaatttggttgagataaacattcctttttaaggaaaagtgaagagcagtgtgctgtcacacaccgttaagccagaggttctgacttcgctaaaggaaatgtaagaggttttgttgtctgttttaaataaatttaattcggaacacatgatccaacagactatgttaaaatattcagggaaatctctcccttcatttactttttcttgctataagcctatatttaggtttcttttctatttttttctcccatttggatcctttgaggtaaaaaaacataatgtcttcagcctcataataaaggaaagttaattaaaaaaaaaaagcaaagagccattttgtcctgttttcttggttccatcaatctgtttattaaacatcatccatatgctgaccctgtctctgtgtggttgggttgggaggcgatcagcagataccatagtgaacgaagaggaaggtttgaaccatgggccccatctttaaagaaagtcattaaaagaaggtaaacttcaaagtgattctggagttctttgaaatgtgctggaagacttaaatttattaatcttaaatcatgtactttttttctgtaatagaactcggattcttttgcatgatggggtaaagcttagcagagaatcatgggagctaacctttatcccacctttgacactaccctccaatcttgcaacactatcctgtttctcagaacagtttttaaatgccaatcatagagggtactgtaaagtgtacaagttactttatatatgtaatgttcacttgagtggaactgctttttacattaaagttaaaatcgatcttgtgtttcttcaaccttcaaaactatctcatctgtcagatttttaaaactccaacacaggttttggcatcttttgtgctgtatcttttaagtgcatgtgaaatttgtaaaatagagataagtacagtatgtatattttgtaaatctcccatttttgtaagaaaatatatattgtatttatacatttttactttggatttttgttttgttggctttaaaggtctaccccactttatcacatgtacagatcacaaataaatttttttaaatacaaaaaattcaacaacacacacacaaaaaaaaagggggggcaaaaattccggggggccctgcccgttttcaaagggccagcg

SEQ ID NO: 436976 - DNA, 3448 bp, Homo sapiens
  misc_feature (133)..(133): n is a, c, g, or t
gagacagagtctcactccgttgcccaggctgggagtgcagtggcacgatctcagctcactgcaacctccgcctcccaggttcaagcgattctcctgcctcagcctcctgagtagctaggataacaggtgtgcnccaccacacccggctaatttttgtatttttagcagagatggggtctcaccatgttggccaacctggtctcgaactcctgacctcaggtgatctccccgcctcggcctcccaaagtgctgggattacaggcgtgagccacgcgcccggcccccagtttatgtgcagataaggcttaggggaaaaaaaaaagcgtcctcttattgtcaatgcgattgcatttctgtagcaggaagtcagaactacttgatggaattttgaactatcagaaactgcaggagatcgaagataaacttggctttaaaaaatgtttcactgattagttcttcccacattcaaacactgcgaatctgtcctccccaggactgcttcatagacccctcctgccctttttccttcacttctagcacttcaatgacaaatgccacctgtcttgatgtcctcctctcttcatctgctagccctgtcctgccagtatctcattcttccctggcccctctttacctggcttcctgtgtatgcctgggtaccgcgcctgtgcagtgtctggtgctcaggaatactgcatcaaaaggcagaattaagcccctgagcagccaggacaaggtctgacaacacgttttaaatcgagtaattgttgctcgctataaatgtgactattcacactgctgcccagtcacattttcaagtagggttggttcccagttcagcaccagaatgaaaactgcattagtcaccacccttcagcatccccagcagtacagcacgctggggagaagggtggagggtggcgattatacaactctgcggtaacgccatgctcttaagaacagcctaattggaccacaaaagaagaatgaaaatggatgtagatgtctgggcatcggaacgatcactctgcatttgagagcataagctcccagtgcagggttgacttatgcgtccttaagtgtcaccgcctatgatggtgtttgtcacggtgagtattaaagcagggggtgacgctgcaccttgccccgggggcaggtggtgaagctacgtgcatccggagtcagcaggtctgaggtcattcctcgccccctcccgcccgctccccgacgtcacgccgactccgtcctcggcggtgaagacattcctcccgggccctgcgccctgcagcgtggtaaccccactgccggagaccgtgcgcaacccagctgctagacccccggcgttgagcggcaaaaccccgccccgagcggcttgccccgcccccggctcgtcactcatgcaactcacccaatggtggcggcggggggcggggctaggactgagggcgccgtgcgccgaagcttgtggcgtcaatgcgcccgccgtgtccatggagagaagctgaggcggccgaccttcggcccgaggcaccggggcgccgggacggcgaagatgtcggcttccttagtccgggcaactgtccgggctgtgagcaagaggaagctgcagcccacccgggcagccctcaccctgacaccttcagcagtaaacaagataaaacaacttcttaaagataagcctgagcatgtaggtgtaaaagttggtgtccgaaccaggggctgtaatggcctttcttatactctagaatatacaaagacaaaaggagattctgatgaagaagttattcaagatggagtcagagtattcatcgaaaagaaagcacagctaacacttttaggaacagaaatggactatgttgaagacaaattatccagtgagtttgtgttcaataacccaaacatcaaagggacttgtggctgtggagaaagctttaatatttgaaatctcaggactcttctggccgtaggttccaggaaagctcgtggaagctttggggctcactgcagaaatcatgtgactgtcacgtgctggaaaataaagtgatacatcttgaaaatgaatccagtgtgttggattccagaagaaatgatatttatattctctataggggacagaaaatgagaagccatcactctttttggatcatttaggtctcttgtatcctttgttttagaaccagtttcattaaagttgccttcctgggcacctgtttatccatttcctgaactgtgtgcactccttagatcgctattgatggcttgatcatccctcagcatttctcccaaccagatcggtgactcctaaaatctgagacaggacatcgtgactgctggtagtaatatggtggtgcattgttttttccacccaaacttaacatagcctttttatacatttttatgaaaaatttcattgtcagctgcctcactgcatactctttaatagtaccaggcaaagattttcttcaactatagtacagattagttctgagtgatggtatcaaaaggtgagaaagacgtcatccgcctttttttaatccatttcttttgccaccctatatgtctgttcagagatgggctctcaagctgactttgattcttttagttgagaagtctcttaaagccatctagcccacctccatcaattccctatgtgaggaagcaaaaccccagggaagccaaagggctcctgtccaccctgacaccacaggccgggggagagtagggactctacccccctctccccttgtaggtgacacatgctctgccctctgaggcagtcagcgaaggcaaatggtctgacttctttatgtggtcaacattttgatagaatttctttataatttgatagagattatattatttttattttattttgagtgggaagaattttaaaacctttttatgtcaattaccatcttgtttctttcacctttgaaacaatggtttgtagcagagatgacattgtagcaacccagaattatgcttttggaatgtggtcctcactgtacaggagaatgtgtaatcttttgttaaaattcccagtgtgcatacattttctggttcctcggtccagttgctaaagttcttagtattttagcctaacatatttatcaccaacttttctttaaaagtgttccttttgtcacttagttactgattttcctgggtttgacataagtattctatgagatgatatatatgctttttttgaaagctgattctcatgaattcaagtagctgagttcctttatgtttcgtttattcactaaagtagctgacacaaaacacaccaaaacctagagcggtagttttatgtaaatgctcatgagtttgtatcaataatataattgttgatccacttataattcgtgcaatactgtatgtatgtagagattgagttgtcaattaaaaaaaatgtggcctctttgtgatcataaaaaaaaaattt

SEQ ID NO: 436977 - DNA, 1814 bp, Homo sapiens
  misc_feature (133)..(133): n is a, c, g, or t
  misc_feature (1674)..(1674): n is a, c, g, or t
  misc_feature (1814)..(1814): n is a, c, g, or t
gagacagagtctcactccgttgcccaggctgggagtgcagtggcacgatctcagctcactgcaacctccgcctcccaggttcaagcgattctcctgcctcagcctcctgagtagctaggataacaggtgtgcnccaccacacccggctaatttttgtatttttagcagagatggggtctcaccatgttggccaacctggtctcgaactcctgacctcaggtgatctccccgcctcggcctcccaaagtgctgggattacaggcgtgagccacgcgcccggcccccagtttatgtgcagataaggcttaggggaaaaaaaaaagcgtcctcttattgtcaatgcgattgcatttctgtagcaggaagtcagaactacttgatggaattttgaactatcagaaactgcaggagatcgaagataaacttggctttaaaaaatgtttcactgattagttcttcccacattcaaacactgcgaatctgtcctccccaggactgcttcatagacccctcctgccctttttccttcacttctagcacttcaatgacaaatgccacctgtcttgatgtcctcctctcttcatctgctagccctgtcctgccagtatctcattcttccctggcccctctttacctggcttcctgtgtatgcctgggtaccgcgcctgtgcagtgtctggtgctcaggaatactgcatcaaaaggcagaattaagcccctgagcagccaggacaaggtctgacaacacgttttaaatcgagtaattgttgctcgctataaatgtgactattcacactgctgcccagtcacattttcaagtagggttggttcccagttcagcaccagaatgaaaactgcattagtcaccacccttcagcatccccagcagtacagcacgctggggagaagggtggagggtggcgattatacaactctgcggtaacgccatgctcttaagaacagcctaattggaccacaaaagaagaatgaaaatggatgtagatgtctgggcatcggaacgatcactctgcatttgagagcataagctcccagtgcagggttgacttatgcgtccttaagtgtcaccgcctatgatggtgtttgtcacggtgagtattaaagcagggggtgacgctgcaccttgccccgggggcaggtggtgaagctacgtgcatccggagtcagcaggtctgaggtcattcctcgccccctcccgcccgctccccgacgtcacgccgactccgtcctcggcggtgaagacattcctcccgggccctgcgccctgcagcgtggtaaccccactgccggagaccgtgcgcaacccagctgctagacccccggcgttgagcggcaaaaccccgccccgagcggcttgccccgcccccggctcgtcactcatgcaactcacccaatggtggcggcggggggcggggctaggactgagggcgccgtgcgccgaagcttgtggcgtcaatgcgcccgccgtgtccatggagagaagctgaggcggccgaccttcggcccgaggcaccggggcgccgggacggcgaagatgtcggcttccttagtccgggcaactgtccgggctgtgagcaagaggaagctgcagcccacccgggcagccctcaccctggtgagtgctcgcggcgcgcggcggggcccgtgacattgctngtgtccgccccgtgcaaggggaggtcacggcggccgggagtggggccgcagggacgcggacacgtcagacctcggcgtcgctccgacccgccgcacagcctcgccgcctccttcgcctccggcccctctttgcaacgatn

SEQ ID NO: 436978 - DNA, 832 bp, Homo sapiens
agcggggggctgggccttggggctgctggatgaatgagacccagcctctgccctgggagtgcagagactcaagacagatatgaccacgtgaagagacaactgtaaaacaagtggaattagagaataaaatcccagcacgatgttcctcactggagacaccagtccagctgaggacaatagagaagccacccttcctcaatgttcacttccagaattatatgcatgtattgagaattttaataaggagagcaagaaatcaaatcttctaaaaatgcatggtatttcacttaacgaagcacaggaagtacttgctagaaacctgaatgtcatgtcattcaccaggggcgctgatgtgagaggagatctccaacctgttatcaggaaaacaattcatgaatctaagggatctggaatggagatattttaaggggcttgcgaagtggaggcgcactactgcaatttcattcggagacataaaatacaacactgagaagagatttgtagagagccaggacatgcctgacgttattttcccccctatagttcgcaagtctttggtcatttatcctcaaattgattatcaaaatgaaggaagttattctcttaaatggaatatgtagtgtattaaaatattttggacgtagatttttgcttttgagagcattgatttaatacacaaaaagtaaagaagccaagtacccaatagaacatctgaagtgagtgtgtacaacacacatgaaggtatattgtacaacattaagccgttaatacagagcaaaagggtccgatttaatctgctaacgtgagaagtggtttggacggtgcaacccat

SEQ ID NO: 436979 - DNA, 2738 bp, Homo sapiens
  misc_feature (133)..(133): n is a, c, g, or t
gagacagagtctcactccgttgcccaggctgggagtgcagtggcacgatctcagctcactgcaacctccgcctcccaggttcaagcgattctcctgcctcagcctcctgagtagctaggataacaggtgtgcnccaccacacccggctaatttttgtatttttagcagagatggggtctcaccatgttggccaacctggtctcgaactcctgacctcaggtgatctccccgcctcggcctcccaaagtgctgggattacaggcgtgagccacgcgcccggcccccagtttatgtgcagataaggcttaggggaaaaaaaaaagcgtcctcttattgtcaatgcgattgcatttctgtagcaggaagtcagaactacttgatggaattttgaactatcagaaactgcaggagatcgaagataaacttggctttaaaaaatgtttcactgattagttcttcccacattcaaacactgcgaatctgtcctccccaggactgcttcatagacccctcctgccctttttccttcacttctagcacttcaatgacaaatgccacctgtcttgatgtcctcctctcttcatctgctagccctgtcctgccagtatctcattcttccctggcccctctttacctggcttcctgtgtatgcctgggtaccgcgcctgtgcagtgtctggtgctcaggaatactgcatcaaaaggcagaattaagcccctgagcagccaggacaaggtctgacaacacgttttaaatcgagtaattgttgctcgctataaatgtgactattcacactgctgcccagtcacattttcaagtagggttggttcccagttcagcaccagaatgaaaactgcattagtcaccacccttcagcatccccagcagtacagcacgctggggagaagggtggagggtggcgattatacaactctgcggtaacgccatgctcttaagaacagcctaattggaccacaaaagaagaatgaaaatggatgtagatgtctgggcatcggaacgatcactctgcatttgagagcataagctcccagtgcagggttgacttatgcgtccttaagtgtcaccgcctatgatggtgtttgtcacggtgagtattaaagcagggggtgacgctgcaccttgccccgggggcaggtggtgaagctacgtgcatccggagtcagcaggtctgaggtcattcctcgccccctcccgcccgctccccgacgtcacgccgactccgtcctcggcggtgaagacattcctcccgggccctgcgccctgcagcgtggtaaccccactgccggagaccgtgcgcaacccagctgctagacccccggcgttgagcggcaaaaccccgccccgagcggcttgccccgcccccggctcgtcactcatgcaactcacccaatggtggcggcggggggcggggctaggactgagggcgccgtgcgccgaagcttgtggcgtcaatgcgcccgccgtgtccatggagagaagctgaggcggccgaccttcggcccgaggcaccggggcgccgggacggcgaagatgtcggcttccttagtccgggcaactgtccgggctgtgagcaagaggaagctgcagcccacccgggcagccctcaccctgacaccttcagcagtaaacaagataaaacaacttcttaaagataagcctgagcatgtaggtgtaaaagttggtgtccgaaccaggggctgtaatggcctttcttatactctagaatatacaaagacaaaaggagattctgatgaagaagttattcaagatggctggagtgcagtggtgtgatctcggcttgctgcaacctccacctccctggttcaagcgatcctcccacctcagcctcccaagtagctgggattataggcgcccaccaccatgcctggttcatttttgtatttttagtggagctgtattatcaactcatgtttttgaggaatcctgtatttccaatttttattcaaagctatttattataatttaatttataattaaaattaattatatttgctgctgcccccttcttccaccctataatctgttaaaacctatctaaaataaataatttatcttgtcattggaagtatgcacttagcttgcagttcttacctacatgggagaatgaggcctagattcctaagtgtgctttcttattaaactaaagttataactatcaataaagaccttttaaaaatgtattattttaaaaattataacacattataaaccttaagattttcatcttaaagaagaggtgacttaattatatattgtttatatttagctaatggctcaatttcttgtaaggaagaaagtttttttgttgtttcgttgttttgtttgtttgttgagacagagtcttgctctcttacccaggctggagtgcagtggcacaatcatggttcactgtagcctctgtctcccgggctcaagcagtcctcccacctcagcctcccgagtagctgggactacaggtgcccaccactgtgcccggctaatttttgtatttttagtggagccagggttttgccctgtttcccagactagaaagctttcttaaattgattgtatttgttggctgggcactgtggctcacacctgtaatcccagcactttgggaggccgaggtgggaggatcacttgagcccaggaatgcaagaccagcttgggccacgtggtgaaaccctgactctaaaaaaattagttggtcctg

SEQ ID NO: 436980 - DNA, 911 bp, Homo sapiens
agcggggggctgggccttggggctgctggatgaatgagacccagcctctgccctgggagtgcagagactcaagacagatatgaccacgtgaagagacaactgtaaaacaagtgtggttgccctagagtttgcagtatatgtttacaactaacccaagaccactttcaaattacactacaccttgcaggcagtgaattagagaataaaatcccagcacgatgttcctcactggagacaccagtccagctgaggacaatagagaagccacccttcctcaatgttcacttccagaattatatgcatgtattgagaattttaataaggagagcaagaaatcaaatcttctaaaaatgcatggtatttcacttaacgaagcacaggaagtacttgctagaaacctgaatgtcatgtcattcaccaggggcgctgatgtgagaggagatctccaacctgttatcaggaaaacaattcatgaatctaagggatctggaatggagatattttaaggggcttgcgaagtggaggcgcactactgcaatttcattcggagacataaaatacaacactgagaagagatttgtagagagccaggacatgcctgacgttattttcccccctatagttcgcaagtctttggtcatttatcctcaaattgattatcaaaatgaaggaagttattctcttaaatggaatatgtagtgtattaaaatattttggacgtagatttttgcttttgagagcattgatttaatacacaaaaagtaaagaagccaagtacccaatagaacatctgaagtgagtgtgtacaacacacatgaaggtatattgtacaacattaagccgttaatacagagcaaaagggtccgatttaatctgctaacgtgagaagtggtttggacggtgcaacccat

SEQ ID NO: 436981 - DNA, 845 bp, Homo sapiens
caaagctgcaggtgtgatgatcttacagaggcagctgataagtgaaatggttgccctagagtttgcagtatatgtttacaactaacccaagaccactttcaaattacactacaccttgcaggcagtgaattagagaataaaatcccagcacgatgttcctcactggagacaccagtccagctgaggacaatagagaagccacccttcctcaatgttcacttccagaattatatgcatgtattgagaattttaataaggagagcaagaaatcaaatcttctaaaaatgcatggtatttcacttaacgaagcacaggaagtacttgctagaaacctgaatgtcatgtcattcaccaggggcgctgatgtgagaggagatctccaacctgttatcaggaaaacaattcatgaatctaagggatctggaatggagatattttaaggggcttgcgaagtggaggcgcactactgcaatttcattcggagacataaaatacaacactgagaagagatttgtagagagccaggacatgcctgacgttattttcccccctatagttcgcaagtctttggtcatttatcctcaaattgattatcaaaatgaaggaagttattctcttaaatggaatatgtagtgtattaaaatattttggacgtagatttttgcttttgagagcattgatttaatacacaaaaagtaaagaagccaagtacccaatagaacatctgaagtgagtgtgtacaacacacatgaaggtatattgtacaacattaagccgttaatacagagcaaaagggtccgatttaatctgctaacgtgagaagtggtttggacggtgcaacccat

SEQ ID NO: 436982 - DNA, 456 bp, Homo sapiens
agcggggggctgggccttggggctgctggatgaatgagacccagcctctgccctgggagtgcagagactcaagacagatatgaccacgtgaagagacaactgtaaaacaagtggcaggtcacagaagctggaaccagttgatcgggccgagcctgcagactccctcatcctttccggccttcaacactgatagctctgctctctctccccaacctcagtgccttcatcctcccctgtgttcccatggatgcttggtcctgactttgcacctctccctcacacccagtgtcctttgtttttcctctgccacttgggaggctgatgggaggatcacctgagcctgggaggttgaggctgcagtgacctgtgttcacgccactgcactccagctggggtgacagaatgagagcctatctcaaagaaaaaaaaaaaacactgctctgtatgatactaaaa

SEQ ID NO: 436983 - DNA, 1967 bp, Homo sapiens
ggccggaggggatcccgggggtgggcgtccccgggggccgatcgcctccacactcctgccggcctgcgctgttcggccgttccggttaagcagaggctgaacgtgcccggtggcgggggttcccggtggtggcccggagtcctagcctggagacaccttcagcagtaaacaagataaaacaacttcttaaagataagcctgagcatgtaggtgtaaaagttggtgtccgaaccaggggctgtaatggcctttcttatactctagaatatacaaagacaaaaggagattctgatgaagaagttattcaagatggagtcagagtattcatcgaaaagaaagcacagctaacacttttaggaacagaaatggactatgttgaagacaaattatccagtgagtttgtgttcaataacccaaacatcaaagggacttgtggctgtggagaaagctttaatatttgaaatctcaggactcttctggccgtaggttccaggaaagctcgtggaagctttggggctcactgcagaaatcatgtgactgtcacgtgctggaaaataaagtgatacatcttgaaaatgaatccagtgtgttggattccagaagaaatgatatttatattctctataggggacagaaaatgagaagccatcactctttttggatcatttaggtctcttgtatcctttgttttagaaccagtttcattaaagttgccttcctgggcacctgtttatccatttcctgaactgtgtgcactccttagatcgctattgatggcttgatcatccctcagcatttctcccaaccagatcggtgactcctaaaatctgagacaggacatcgtgactgctggtagtaatatggtggtgcattgttttttccacccaaacttaacatagcctttttatacatttttatgaaaaatttcattgtcagctgcctcactgcatactctttaatagtaccaggcaaagattttcttcaactatagtacagattagttctgagtgatggtatcaaaaggtgagaaagacgtcatccgcctttttttaatccatttcttttgccaccctatatgtctgttcagagatgggctctcaagctgactttgattcttttagttgagaagtctcttaaagccatctagcccacctccatcaattccctatgtgaggaagcaaaaccccagggaagccaaagggctcctgtccaccctgacaccacaggccgggggagagtagggactctacccccctctccccttgtaggtgacacatgctctgccctctgaggcagtcagcgaaggcaaatggtctgacttctttatgtggtcaacattttgatagaatttctttataatttgatagagattatattatttttattttattttgagtgggaagaattttaaaacctttttatgtcaattaccatcttgtttctttcacctttgaaacaatggtttgtagcagagatgacattgtagcaacccagaattatgcttttggaatgtggtcctcactgtacaggagaatgtgtaatcttttgttaaaattcccagtgtgcatacattttctggttcctcggtccagttgctaaagttcttagtattttagcctaacatatttatcaccaacttttctttaaaagtgttccttttgtcacttagttactgattttcctgggtttgacataagtattctatgagatgatatatatgctttttttgaaagctgattctcatgaattcaagtagctgagttcctttatgtttcgtttattcactaaagtagctgacacaaaacacaccaaaacctagagcggtagttttatgtaaatgctcatgagtttgtatcaataatataattgttgatccacttataattcgtgcaatactgtatgtatgtagagattgagttgtcaattaaaaaaaatgtggcctctttgtgatcataaaaaaaaaattt

SEQ ID NO: 436984 - DNA, 2141 bp, Homo sapiens
tgttttccgtcctgtaaccagaaaagactattgttgtactgattgatgttattaaaatagccccattgtatcacagtcctttgtacatctttaagcttgaatccgtgtatctagtgtattgcagaattttcataaatttttttttatttcataaaactcatcgagaatatacattttcttcacgttgcaaactggaaaaatgagtgaagtatagtgaaaggtaaattctaattttgcataaaattgtcatggaatttacttgtataaaattctcccctaatgtgattgtgacataaattcatgtgtgggaaagaaggggcagacaggaaactgaatgcttaattccttaaggaaataatttaaaatgttcaaggcttcttgtttgactttcattgatagtcactatttcaagttcacttgtgctttgaatcagcaagttccataaggctgcaggctttccatgacacatgttttcttttctccaaggagtcagagtattcatcgaaaagaaagcacagctaacacttttaggaacagaaatggactatgttgaagacaaattatccagtgagtttgtgttcaataacccaaacatcaaagggacttgtggctgtggagaaagctttaatatttgaaatctcaggactcttctggccgtaggttccaggaaagctcgtggaagctttggggctcactgcagaaatcatgtgactgtcacgtgctggaaaataaagtgatacatcttgaaaatgaatccagtgtgttggattccagaagaaatgatatttatattctctataggggacagaaaatgagaagccatcactctttttggatcatttaggtctcttgtatcctttgttttagaaccagtttcattaaagttgccttcctgggcacctgtttatccatttcctgaactgtgtgcactccttagatcgctattgatggcttgatcatccctcagcatttctcccaaccagatcggtgactcctaaaatctgagacaggacatcgtgactgctggtagtaatatggtggtgcattgttttttccacccaaacttaacatagcctttttatacatttttatgaaaaatttcattgtcagctgcctcactgcatactctttaatagtaccaggcaaagattttcttcaactatagtacagattagttctgagtgatggtatcaaaaggtgagaaagacgtcatccgcctttttttaatccatttcttttgccaccctatatgtctgttcagagatgggctctcaagctgactttgattcttttagttgagaagtctcttaaagccatctagcccacctccatcaattccctatgtgaggaagcaaaaccccagggaagccaaagggctcctgtccaccctgacaccacaggccgggggagagtagggactctacccccctctccccttgtaggtgacacatgctctgccctctgaggcagtcagcgaaggcaaatggtctgacttctttatgtggtcaacattttgatagaatttctttataatttgatagagattatattatttttattttattttgagtgggaagaattttaaaacctttttatgtcaattaccatcttgtttctttcacctttgaaacaatggtttgtagcagagatgacattgtagcaacccagaattatgcttttggaatgtggtcctcactgtacaggagaatgtgtaatcttttgttaaaattcccagtgtgcatacattttctggttcctcggtccagttgctaaagttcttagtattttagcctaacatatttatcaccaacttttctttaaaagtgttccttttgtcacttagttactgattttcctgggtttgacataagtattctatgagatgatatatatgctttttttgaaagctgattctcatgaattcaagtagctgagttcctttatgtttcgtttattcactaaagtagctgacacaaaacacaccaaaacctagagcggtagttttatgtaaatgctcatgagtttgtatcaataatataattgttgatccacttataattcgtgcaatactgtatgtatgtagagattgagttgtcaattaaaaaaaatgtggcctctttgtgatcataaaaaaaaaattt

SEQ ID NO: 436985 - DNA, 3532 bp, Homo sapiens
  misc_feature (133)..(133): n is a, c, g, or t
gagacagagtctcactccgttgcccaggctgggagtgcagtggcacgatctcagctcactgcaacctccgcctcccaggttcaagcgattctcctgcctcagcctcctgagtagctaggataacaggtgtgcnccaccacacccggctaatttttgtatttttagcagagatggggtctcaccatgttggccaacctggtctcgaactcctgacctcaggtgatctccccgcctcggcctcccaaagtgctgggattacaggcgtgagccacgcgcccggcccccagtttatgtgcagataaggcttaggggaaaaaaaaaagcgtcctcttattgtcaatgcgattgcatttctgtagcaggaagtcagaactacttgatggaattttgaactatcagaaactgcaggagatcgaagataaacttggctttaaaaaatgtttcactgattagttcttcccacattcaaacactgcgaatctgtcctccccaggactgcttcatagacccctcctgccctttttccttcacttctagcacttcaatgacaaatgccacctgtcttgatgtcctcctctcttcatctgctagccctgtcctgccagtatctcattcttccctggcccctctttacctggcttcctgtgtatgcctgggtaccgcgcctgtgcagtgtctggtgctcaggaatactgcatcaaaaggcagaattaagcccctgagcagccaggacaaggtctgacaacacgttttaaatcgagtaattgttgctcgctataaatgtgactattcacactgctgcccagtcacattttcaagtagggttggttcccagttcagcaccagaatgaaaactgcattagtcaccacccttcagcatccccagcagtacagcacgctggggagaagggtggagggtggcgattatacaactctgcggtaacgccatgctcttaagaacagcctaattggaccacaaaagaagaatgaaaatggatgtagatgtctgggcatcggaacgatcactctgcatttgagagcataagctcccagtgcagggttgacttatgcgtccttaagtgtcaccgcctatgatggtgtttgtcacggtgagtattaaagcagggggtgacgctgcaccttgccccgggggcaggtggtgaagctacgtgcatccggagtcagcaggtctgaggtcattcctcgccccctcccgcccgctccccgacgtcacgccgactccgtcctcggcggtgaagacattcctcccgggccctgcgccctgcagcgtggtaaccccactgccggagaccgtgcgcaacccagctgctagacccccggcgttgagcggcaaaaccccgccccgagcggcttgccccgcccccggctcgtcactcatgcaactcacccaatggtggcggcggggggcggggctaggactgagggcgccgtgcgccgaagcttgtggcgtcaatgcgcccgccgtgtccatggagagaagctgaggcggccgaccttcggcccgaggcaccggggcgccgggacggcgaagatgtcggcttccttagtccgggcaactgtccgggctgtgagcaagaggaagctgcagcccacccgggcagccctcaccctgacaccttcagcagtaaacaagataaaacaacttcttaaagataagcctgagcatgtaggtgtaaaagttggtgtccgaaccaggggctgtaatggcctttcttatactctagaatatacaaagacaaaaggagattctgatgaagaagttattcaagatggagtcagagtattcatcgaaaagaaagcacagctaacacttttaggaacagaaatggactatgttgaagacaaattatccagtgagtttgtgttcaataacccaaacatcaaagggacttgtggctgtggagaaagctttaatatttgaaatctcaggactcttctggccgtaggttccaggaaagctcgtggaagctttggggctcactgcagaaatcatgtgactgtcacgtgctggaaaataaagtgatacatcttgaaaatgaatccagtgtgttggattccagaagaaatgatatttatattctctataggggacagaaaatgagaagccatcactctttttggatcatttaggtctcttgtatcctttgttttagaaccagtttcattaaagttgccttcctgggcacctgtttatccatttcctatctgtactatagttgaagaaaatcttggcctggtactattaaagagtatgcagtgaggcagctgacaatgaaatttttcataagaatgtataaaaaggctatgttaagtttgggtggaaaaaacaatgcaccaccatattactaccagcagtcacgatgtcctgtctcagattttaggagtcaccgatgctggtagtaatatggtggtgcattgttttttccacccaaacttaacatagcctttttatacatttttatgaaaaatttcattgtcagctgcctcactgcatactctttaatagtaccaggcaaagattttcttcaactatagtacagattagttctgagtgatggtatcaaaaggtgagaaagacgtcatccgcctttttttaatccatttcttttgccaccctatatgtctgttcagagatgggctctcaagctgactttgattcttttagttgagaagtctcttaaagccatctagcccacctccatcaattccctatgtgaggaagcaaaaccccagggaagccaaagggctcctgtccaccctgacaccacaggccgggggagagtagggactctacccccctctccccttgtaggtgacacatgctctgccctctgaggcagtcagcgaaggcaaatggtctgacttctttatgtggtcaacattttgatagaatttctttataatttgatagagattatattatttttattttattttgagtgggaagaattttaaaacctttttatgtcaattaccatcttgtttctttcacctttgaaacaatggtttgtagcagagatgacattgtagcaacccagaattatgcttttggaatgtggtcctcactgtacaggagaatgtgtaatcttttgttaaaattcccagtgtgcatacattttctggttcctcggtccagttgctaaagttcttagtattttagcctaacatatttatcaccaacttttctttaaaagtgttccttttgtcacttagttactgattttcctgggtttgacataagtattctatgagatgatatatatgctttttttgaaagctgattctcatgaattcaagtagctgagttcctttatgtttcgtttattcactaaagtagctgacacaaaacacaccaaaacctagagcggtagttttatgtaaatgctcatgagtttgtatcaataatataattgttgatccacttataattcgtgcaatactgtatgtatgtagagattgagttgtcaattaaaaaaaatgtggcctctttgtgatcataaaaaaaaaattt

SEQ ID NO: 436986 - DNA, 2083 bp, Homo sapiens
  misc_feature (133)..(133): n is a, c, g, or t
  misc_feature (2054)..(2054): n is a, c, g, or t
  misc_feature (2057)..(2057): n is a, c, g, or t
gagacagagtctcactccgttgcccaggctgggagtgcagtggcacgatctcagctcactgcaacctccgcctcccaggttcaagcgattctcctgcctcagcctcctgagtagctaggataacaggtgtgcnccaccacacccggctaatttttgtatttttagcagagatggggtctcaccatgttggccaacctggtctcgaactcctgacctcaggtgatctccccgcctcggcctcccaaagtgctgggattacaggcgtgagccacgcgcccggcccccagtttatgtgcagataaggcttaggggaaaaaaaaaagcgtcctcttattgtcaatgcgattgcatttctgtagcaggaagtcagaactacttgatggaattttgaactatcagaaactgcaggagatcgaagataaacttggctttaaaaaatgtttcactgattagttcttcccacattcaaacactgcgaatctgtcctccccaggactgcttcatagacccctcctgccctttttccttcacttctagcacttcaatgacaaatgccacctgtcttgatgtcctcctctcttcatctgctagccctgtcctgccagtatctcattcttccctggcccctctttacctggcttcctgtgtatgcctgggtaccgcgcctgtgcagtgtctggtgctcaggaatactgcatcaaaaggcagaattaagcccctgagcagccaggacaaggtctgacaacacgttttaaatcgagtaattgttgctcgctataaatgtgactattcacactgctgcccagtcacattttcaagtagggttggttcccagttcagcaccagaatgaaaactgcattagtcaccacccttcagcatccccagcagtacagcacgctggggagaagggtggagggtggcgattatacaactctgcggtaacgccatgctcttaagaacagcctaattggaccacaaaagaagaatgaaaatggatgtagatgtctgggcatcggaacgatcactctgcatttgagagcataagctcccagtgcagggttgacttatgcgtccttaagtgtcaccgcctatgatggtgtttgtcacggtgagtattaaagcagggggtgacgctgcaccttgccccgggggcaggtggtgaagctacgtgcatccggagtcagcaggtctgaggtcattcctcgccccctcccgcccgctccccgacgtcacgccgactccgtcctcggcggtgaagacattcctcccgggccctgcgccctgcagcgtggtaaccccactgccggagaccgtgcgcaacccagctgctagacccccggcgttgagcggcaaaaccccgccccgagcggcttgccccgcccccggctcgtcactcatgcaactcacccaatggtggcggcggggggcggggctaggactgagggcgccgtgcgccgaagcttgtggcgtcaatgcgcccgccgtgtccatggagagaagctgaggcggccgaccttcggcccgaggcaccggggcgccgggacggcgaagatgtcggcttccttagtccgggcaactgtccgggctgtgagcaagaggaagctgcagcccacccgggcagccctcaccctgacaccttcagcagtaaacaagataaaacaacttcttaaagataagcctgagcatgtaggtgtaaaagttggtgtccgaaccaggggctgtaatggcctttcttatactctagaatatacaaagacaaaaggagattctgatgaagaagttattcaagatggagtcagagtattcatcgaaaagaaagcacagctaacacttttaggaacagaaatggactatgttgaagacaaattatccagtgagtttgtgttcaataacccaaacatcaaagggacttgtggctgtggagaaagctttaatatttgaaatctcaggactcttctggccgtaggttccaggaaagctcgtggaagctttggggctcactgcagaaatcatgtgactgtcacgtgctggtgtgatacatctggggggacanganatgaggccatcacttcttttggatct

SEQ ID NO: 436987 - DNA, 2149 bp, Homo sapiens
  misc_feature (133)..(133): n is a, c, g, or t
gagacagagtctcactccgttgcccaggctgggagtgcagtggcacgatctcagctcactgcaacctccgcctcccaggttcaagcgattctcctgcctcagcctcctgagtagctaggataacaggtgtgcnccaccacacccggctaatttttgtatttttagcagagatggggtctcaccatgttggccaacctggtctcgaactcctgacctcaggtgatctccccgcctcggcctcccaaagtgctgggattacaggcgtgagccacgcgcccggcccccagtttatgtgcagataaggcttaggggaaaaaaaaaagcgtcctcttattgtcaatgcgattgcatttctgtagcaggaagtcagaactacttgatggaattttgaactatcagaaactgcaggagatcgaagataaacttggctttaaaaaatgtttcactgattagttcttcccacattcaaacactgcgaatctgtcctccccaggactgcttcatagacccctcctgccctttttccttcacttctagcacttcaatgacaaatgccacctgtcttgatgtcctcctctcttcatctgctagccctgtcctgccagtatctcattcttccctggcccctctttacctggcttcctgtgtatgcctgggtaccgcgcctgtgcagtgtctggtgctcaggaatactgcatcaaaaggcagaattaagcccctgagcagccaggacaaggtctgacaacacgttttaaatcgagtaattgttgctcgctataaatgtgactattcacactgctgcccagtcacattttcaagtagggttggttcccagttcagcaccagaatgaaaactgcattagtcaccacccttcagcatccccagcagtacagcacgctggggagaagggtggagggtggcgattatacaactctgcggtaacgccatgctcttaagaacagcctaattggaccacaaaagaagaatgaaaatggatgtagatgtctgggcatcggaacgatcactctgcatttgagagcataagctcccagtgcagggttgacttatgcgtccttaagtgtcaccgcctatgatggtgtttgtcacggtgagtattaaagcagggggtgacgctgcaccttgccccgggggcaggtggtgaagctacgtgcatccggagtcagcaggtctgaggtcattcctcgccccctcccgcccgctccccgacgtcacgccgactccgtcctcggcggtgaagacattcctcccgggccctgcgccctgcagcgtggtaaccccactgccggagaccgtgcgcaacccagctgctagacccccggcgttgagcggcaaaaccccgccccgagcggcttgccccgcccccggctcgtcactcatgcaactcacccaatggtggcggcggggggcggggctaggactgagggcgccgtgcgccgaagcttgtggcgtcaatgcgcccgccgtgtccatggagagaagctgaggcggccgaccttcggcccgaggcaccggggcgccgggacggcgaagatgtcggcttccttagtccgggcaactgtccgggctgtgagcaagaggaagctgcagcccacccgggcagccctcaccctgacaccttcagcagtaaacaagataaaacaacttcttaaagataagcctgagcatgtaggtgtaaaagttggtgtccgaaccaggggctgtaatggcctttcttatactctagaatatacaaagacaaaaggagattctgatgaagaagttattcaagatggaattagagaataaaatcccagcacgatgttcctcactggagacaccagtccagctgaggacaatagagaagccacccttcctcaatgttcacttccagaattatatgcatgtattgagaattttaataaggagagcaagaaatcaaatcttctaaaaatgcatggtatttcacttaacgaagcacaggaagtacttgctagaaacctgaatgtcatgtcattcaccaggggcgctgatgtgagaggagatctccaacctgttatcagtgtcaataaaatgaacaagcctggaaaacatagaaagaccccatctccaaaaataaataaataaataaataaataaataaaaattagc

SEQ ID NO: 436988 - DNA, 735 bp, Homo sapiens
agcggggggctgggccttggggctgctggatgaatgagacccagcctctgccctgggagtgcagagactcaagacagatatgaccacgtgaagagacaactgtaaaacaagtgtggttgccctagagtttgcagtatatgtttacaactaacccaagaccactttcaaattacactacaccttgcaggcagtgaattagagaataaaatcccagcacgatgttcctcactggagacaccagtccagctgaggacaatagagaagccacccttcctcaatgttcagaaaacaattcatgaatctaagggatctggaatggagatattttaaggggcttgcgaagtggaggcgcactactgcaatttcattcggagacataaaatacaacactgagaagagatttgtagagagccaggacatgcctgacgttattttcccccctatagttcgcaagtctttggtcatttatcctcaaattgattatcaaaatgaaggaagttattctcttaaatggaatatgtagtgtattaaaatattttggacgtagatttttgcttttgagagcattgatttaatacacaaaaagtaaagaagccaagtacccaatagaacatctgaagtgagtgtgtacaacacacatgaaggtatattgtacaacattaagccgttaatacagagcaaaagggtccgatttaatctgctaacgtgagaagtggtttggacggtgcaacccat

SEQ ID NO: 436989 - DNA, 469 bp, Homo sapiens
gtgcgtggggtggggagggaccaggctgtccgaaggaccgctgtgtcggggcgacagcgttcgcagagggcgagcacagcgacaacaaagcccccggctcctgccgaggtcacggccgcggcgcgcaaagcgttacttgccggtgtcctgggtgattgaggcctttgaaactccctctgtgcctctagcaagcctaggctcttaggacaaaagatgatttcccagagtgagtttacagccttttctgggtgaaaggtcaaacactcagagggcaccagagtgcaaccattgattacttagagaattcactgagctcagtgttccggccgcaccgttcagttttttagtggaaggaaaatccacataacataaaattagtccttttaaagggtacaattcagtgccatttaagacattcacagtgtcgtgcaaccatcacctctatctagttccaaaatactttcacccc

SEQ ID NO: 436990 - DNA, 440 bp, Homo sapiens
cagagcagtgaaaactaagccagtctaggcttggcaaggagagatggagtgaggtgggcagtggctaaggtgggaagaccagagctgggaggtgagatgggatttgggtttatctttaccaataaggatgaggagcctgtttcatcttcctccaggcaggtcacagaagctggaaccagttgatcgggccgagcctgcagactccctcatcctttccggccttcaacactgatagctctgctctctctccccaacctcagtgccttcatcctcccctgtgttcccatggatgcttggtcctgactttgcacctctccctcacacccagtgtcctttgtttttcctctgccacttgggaggctgatgggaggatcacctgagcctgggaggttgaggctgcagtgacctgtgttcacgccactgcactccagctggggtga

SEQ ID NO: 436991 - DNA, 2224 bp, Homo sapiens
  misc_feature (133)..(133): n is a, c, g, or t
gagacagagtctcactccgttgcccaggctgggagtgcagtggcacgatctcagctcactgcaacctccgcctcccaggttcaagcgattctcctgcctcagcctcctgagtagctaggataacaggtgtgcnccaccacacccggctaatttttgtatttttagcagagatggggtctcaccatgttggccaacctggtctcgaactcctgacctcaggtgatctccccgcctcggcctcccaaagtgctgggattacaggcgtgagccacgcgcccggcccccagtttatgtgcagataaggcttaggggaaaaaaaaaagcgtcctcttattgtcaatgcgattgcatttctgtagcaggaagtcagaactacttgatggaattttgaactatcagaaactgcaggagatcgaagataaacttggctttaaaaaatgtttcactgattagttcttcccacattcaaacactgcgaatctgtcctccccaggactgcttcatagacccctcctgccctttttccttcacttctagcacttcaatgacaaatgccacctgtcttgatgtcctcctctcttcatctgctagccctgtcctgccagtatctcattcttccctggcccctctttacctggcttcctgtgtatgcctgggtaccgcgcctgtgcagtgtctggtgctcaggaatactgcatcaaaaggcagaattaagcccctgagcagccaggacaaggtctgacaacacgttttaaatcgagtaattgttgctcgctataaatgtgactattcacactgctgcccagtcacattttcaagtagggttggttcccagttcagcaccagaatgaaaactgcattagtcaccacccttcagcatccccagcagtacagcacgctggggagaagggtggagggtggcgattatacaactctgcggtaacgccatgctcttaagaacagcctaattggaccacaaaagaagaatgaaaatggatgtagatgtctgggcatcggaacgatcactctgcatttgagagcataagctcccagtgcagggttgacttatgcgtccttaagtgtcaccgcctatgatggtgtttgtcacggtgagtattaaagcagggggtgacgctgcaccttgccccgggggcaggtggtgaagctacgtgcatccggagtcagcaggtctgaggtcattcctcgccccctcccgcccgctccccgacgtcacgccgactccgtcctcggcggtgaagacattcctcccgggccctgcgccctgcagcgtggtaaccccactgccggagaccgtgcgcaacccagctgctagacccccggcgttgagcggcaaaaccccgccccgagcggcttgccccgcccccggctcgtcactcatgcaactcacccaatggtggcggcggggggcggggctaggactgagggcgccgtgcgccgaagcttgtggcgtcaatgcgcccgccgtgtccatggagagaagctgaggcggccgaccttcggcccgaggcaccggggcgccgggacggcgaagatgtcggcttccttagtccgggcaactgtccgggctgtgagcaagaggaagctgcagcccacccgggcagccctcaccctgacaccttcagcagtaaacaagataaaacaacttcttaaagataagcctgagcatgtaggtgtaaaagttggtgtccgaaccaggggctgtaatggcctttcttatactctagaatatacaaagacaaaaggagattctgatgaagaagttattcaagatggagtcagagtattcatcgaaaagaaagcacagctaacacttttaggaacagaaatggactatgttgaagacaaattatccagtgagtttgtgttcaataacccaaacatcaaagggacttgtggctgtggagaaagctttaatatttgaaatctcaggactcttctggccgtaggttccaggaaagctcgtggaagctttggggctcactgcagaaatcatgtgactgtcacgtgctggaaaataaagtgatacatcttgaaaatgaatccagtgtgttggattccagaagaaatgatatttatattctctataggggacagaaaatgagaagccatcactctttttggatcatttaggtctcttgtatcctttgttttagaaccagtttcattaaagttgccttcctgggcacctgtttatccatttcct

SEQ ID NO: 436992 - DNA, 2085 bp, Homo sapiens
  misc_feature (133)..(133): n is a, c, g, or t
gagacagagtctcactccgttgcccaggctgggagtgcagtggcacgatctcagctcactgcaacctccgcctcccaggttcaagcgattctcctgcctcagcctcctgagtagctaggataacaggtgtgcnccaccacacccggctaatttttgtatttttagcagagatggggtctcaccatgttggccaacctggtctcgaactcctgacctcaggtgatctccccgcctcggcctcccaaagtgctgggattacaggcgtgagccacgcgcccggcccccagtttatgtgcagataaggcttaggggaaaaaaaaaagcgtcctcttattgtcaatgcgattgcatttctgtagcaggaagtcagaactacttgatggaattttgaactatcagaaactgcaggagatcgaagataaacttggctttaaaaaatgtttcactgattagttcttcccacattcaaacactgcgaatctgtcctccccaggactgcttcatagacccctcctgccctttttccttcacttctagcacttcaatgacaaatgccacctgtcttgatgtcctcctctcttcatctgctagccctgtcctgccagtatctcattcttccctggcccctctttacctggcttcctgtgtatgcctgggtaccgcgcctgtgcagtgtctggtgctcaggaatactgcatcaaaaggcagaattaagcccctgagcagccaggacaaggtctgacaacacgttttaaatcgagtaattgttgctcgctataaatgtgactattcacactgctgcccagtcacattttcaagtagggttggttcccagttcagcaccagaatgaaaactgcattagtcaccacccttcagcatccccagcagtacagcacgctggggagaagggtggagggtggcgattatacaactctgcggtaacgccatgctcttaagaacagcctaattggaccacaaaagaagaatgaaaatggatgtagatgtctgggcatcggaacgatcactctgcatttgagagcataagctcccagtgcagggttgacttatgcgtccttaagtgtcaccgcctatgatggtgtttgtcacggtgagtattaaagcagggggtgacgctgcaccttgccccgggggcaggtggtgaagctacgtgcatccggagtcagcaggtctgaggtcattcctcgccccctcccgcccgctccccgacgtcacgccgactccgtcctcggcggtgaagacattcctcccgggccctgcgccctgcagcgtggtaaccccactgccggagaccgtgcgcaacccagctgctagacccccggcgttgagcggcaaaaccccgccccgagcggcttgccccgcccccggctcgtcactcatgcaactcacccaatggtggcggcggggggcggggctaggactgagggcgccgtgcgccgaagcttgtggcgtcaatgcgcccgccgtgtccatggagagaagctgaggcggccgaccttcggcccgaggcaccggggcgccgggacggcgaagatgtcggcttccttagtccgggcaactgtccgggctgtgagcaagaggaagctgcagcccacccgggcagccctcaccctgacaccttcagcagtaaacaagataaaacaacttcttaaagataagcctgagcatgtaggtgtaaaagttggtgtccgaaccaggggctgtaatggcctttcttatactctagaatatacaaagacaaaaggagattctgatgaagaagttattcaagatggaattagagaataaaatcccagcacgatgttcctcactggagacaccagtccagctgaggacaatagagaagccacccttcctcaatgttcacttccagaattatatgcatgtattgagaattttaataaggagagcaagaaatcaaatcttctaaaaatgcatggtatttcacttaacgaagcacaggaagtacttgctagaaacctgaatgtcatgtcattcaccaggggcgctgatgtgagaggagatctccaacctgttatcaggtgcacagtggttaaaaaagagaa

SEQ ID NO: 436993 - DNA, 3121 bp, Homo sapiens
  misc_feature (133)..(133): n is a, c, g, or t
gagacagagtctcactccgttgcccaggctgggagtgcagtggcacgatctcagctcactgcaacctccgcctcccaggttcaagcgattctcctgcctcagcctcctgagtagctaggataacaggtgtgcnccaccacacccggctaatttttgtatttttagcagagatggggtctcaccatgttggccaacctggtctcgaactcctgacctcaggtgatctccccgcctcggcctcccaaagtgctgggattacaggcgtgagccacgcgcccggcccccagtttatgtgcagataaggcttaggggaaaaaaaaaagcgtcctcttattgtcaatgcgattgcatttctgtagcaggaagtcagaactacttgatggaattttgaactatcagaaactgcaggagatcgaagataaacttggctttaaaaaatgtttcactgattagttcttcccacattcaaacactgcgaatctgtcctccccaggactgcttcatagacccctcctgccctttttccttcacttctagcacttcaatgacaaatgccacctgtcttgatgtcctcctctcttcatctgctagccctgtcctgccagtatctcattcttccctggcccctctttacctggcttcctgtgtatgcctgggtaccgcgcctgtgcagtgtctggtgctcaggaatactgcatcaaaaggcagaattaagcccctgagcagccaggacaaggtctgacaacacgttttaaatcgagtaattgttgctcgctataaatgtgactattcacactgctgcccagtcacattttcaagtagggttggttcccagttcagcaccagaatgaaaactgcattagtcaccacccttcagcatccccagcagtacagcacgctggggagaagggtggagggtggcgattatacaactctgcggtaacgccatgctcttaagaacagcctaattggaccacaaaagaagaatgaaaatggatgtagatgtctgggcatcggaacgatcactctgcatttgagagcataagctcccagtgcagggttgacttatgcgtccttaagtgtcaccgcctatgatggtgtttgtcacggtgagtattaaagcagggggtgacgctgcaccttgccccgggggcaggtggtgaagctacgtgcatccggagtcagcaggtctgaggtcattcctcgccccctcccgcccgctccccgacgtcacgccgactccgtcctcggcggtgaagacattcctcccgggccctgcgccctgcagcgtggtaaccccactgccggagaccgtgcgcaacccagctgctagacccccggcgttgagcggcaaaaccccgccccgagcggcttgccccgcccccggctcgtcactcatgcaactcacccaatggtggcggcggggggcggggctaggactgagggcgccgtgcgccgaagcttgtggcgtcaatgcgcccgccgtgtccatggagagaagctgaggcggccgaccttcggcccgaggcaccggggcgccgggacggcgaagatgtcggcttccttagtccgggcaactgtccgggctgtgagcaagaggaagctgcagcccacccgggcagccctcaccctgacaccttcagcagtaaacaagataaaacaacttcttaaagataagcctgagcatgtaggtgtaaaagttggtgtccgaaccaggggctgtaatggcctttcttatactctagaatatacaaagacaaaaggagattctgatgaagaagttattcaagatggagtcagagtattcatcgaaaagaaagcacagctaacacttttaggaacagaaatggactatgttgaagacaaattatccagtgagtttgtgttcaataacccaaacatcaaagggacttgtggctgtggagaaagctttaatatttgaaatctcaggactcttctggccgtaggttccaggaaagctcgtggaagctttggggctcactgcagaaatcatgtgactgtcacgtgctggaaaataaagtgatacatcttgaaaatgaatccagtgtgttggattccagaagaaatgatatttatattctctataggggacagaaaatgagaagccatcactctttttggatcatttaggtctcttgtatcctttgttttagaaccagtttcattaaagttgccttcctgggcacctgtttatccatttcctgaactgtgtgcactccttagatcgctattgatggcttgatcatccctcagcatttctcccaaccagatcggtgactcctaaaatctgagacaggacatcgtgactgctggtagtaatatggtggtgcattgttttttccacccaaacttaacatagcctttttatacatttttatgaaaaatttcattgtcagctgcctcactgcatactctttaatagtaccaggcaaagattttcttcaactatagtacagattagttctgagtgatggtatcaaaaggtgagaaagacgtcatccgcctttttttaatccatttcttttgccaccctatatgtctgttcagagatgggctctcaagctgactttgattcttttagttgagaagtctcttaaagccatctagcccacctccatcaattccctatgtgaggaagcaaaaccccagggaagccaaagggctcctgtccaccctgacaccacaggccgggggagagtagggactctacccccctctccccttgtaggtgacacatgctctgccctctgaggcagtcagcgaaggcaaatggtctgacttctttatgtggtcaacattttgatagaatttctttataatttgatagagattatattatttttattttctctcgtggtagcttgtatccgtcctcagaaatgtgatgttagattctagaaatagtgatagctacttttaataaacacaaactgtgtgtctggcaccaggctaagtagtttaagttcatgtgctcatttactcttcacaatagcacaatggtgtaagaactattatcattcctactttctaagtgagaaaactgagaatagtaattgttcaacacgatctaatttgtaggtggtggagctgggactcagtt

SEQ ID NO: 436994 - DNA, 2268 bp, Homo sapiens
  misc_feature (133)..(133): n is a, c, g, or t
gagacagagtctcactccgttgcccaggctgggagtgcagtggcacgatctcagctcactgcaacctccgcctcccaggttcaagcgattctcctgcctcagcctcctgagtagctaggataacaggtgtgcnccaccacacccggctaatttttgtatttttagcagagatggggtctcaccatgttggccaacctggtctcgaactcctgacctcaggtgatctccccgcctcggcctcccaaagtgctgggattacaggcgtgagccacgcgcccggcccccagtttatgtgcagataaggcttaggggaaaaaaaaaagcgtcctcttattgtcaatgcgattgcatttctgtagcaggaagtcagaactacttgatggaattttgaactatcagaaactgcaggagatcgaagataaacttggctttaaaaaatgtttcactgattagttcttcccacattcaaacactgcgaatctgtcctccccaggactgcttcatagacccctcctgccctttttccttcacttctagcacttcaatgacaaatgccacctgtcttgatgtcctcctctcttcatctgctagccctgtcctgccagtatctcattcttccctggcccctctttacctggcttcctgtgtatgcctgggtaccgcgcctgtgcagtgtctggtgctcaggaatactgcatcaaaaggcagaattaagcccctgagcagccaggacaaggtctgacaacacgttttaaatcgagtaattgttgctcgctataaatgtgactattcacactgctgcccagtcacattttcaagtagggttggttcccagttcagcaccagaatgaaaactgcattagtcaccacccttcagcatccccagcagtacagcacgctggggagaagggtggagggtggcgattatacaactctgcggtaacgccatgctcttaagaacagcctaattggaccacaaaagaagaatgaaaatggatgtagatgtctgggcatcggaacgatcactctgcatttgagagcataagctcccagtgcagggttgacttatgcgtccttaagtgtcaccgcctatgatggtgtttgtcacggtgagtattaaagcagggggtgacgctgcaccttgccccgggggcaggtggtgaagctacgtgcatccggagtcagcaggtctgaggtcattcctcgccccctcccgcccgctccccgacgtcacgccgactccgtcctcggcggtgaagacattcctcccgggccctgcgccctgcagcgtggtaaccccactgccggagaccgtgcgcaacccagctgctagacccccggcgttgagcggcaaaaccccgccccgagcggcttgccccgcccccggctcgtcactcatgcaactcacccaatggtggcggcggggggcggggctaggactgagggcgccgtgcgccgaagcttgtggcgtcaatgcgcccgccgtgtccatggagagaagctgaggcggccgaccttcggcccgaggcaccggggcgccgggacggcgaagatgtcggcttccttagtccgggcaactgtccgggctgtgagcaagaggaagctgcagcccacccgggcagccctcaccctgacaccttcagcagtaaacaagataaaacaacttcttaaagataagcctgagcatgtaggtgtaaaagttggtgtccgaaccaggggctgtaatggcctttcttatactctagaatatacaaagacaaaaggagattctgatgaagaagttattcaagatgagtctcactctgtcgccaggctggagtgcagtggcacaatctcagcttaccgcaacctccgcctcccgggttcaagtgattcctttgtctcggcctcctgagtagctgggactacaggcatgcgccgccacgcctggctaattttttgtatttttagtagagatggggtttcaccatgttggccaggatggtctcaatctcctgacctcgagatcagccctcctcggcctcccaaagtggtgggattacaggcatgagccactgcacccagctgaccttgaacaaattacttctctgtgccttcatcgtagaaaacaatttcttagaatttgtcgctaggattcactgagttaacacacacatagaacagctcctagcacattataagcagctaaatacttattagctactacttataattgggtacccatgtgacctggagagtgggcttcattcctcatactccgggtctgca

SEQ ID NO: 436995 - DNA, 1197 bp, Homo sapiens
gaaggtggcagagcagcctccccaactaagcctgggtcgccgcctcggtgaagggccgcggggccgagcgcgggaagtggcgtccagtcggtttttggcaggcgagagccagagcgtgagaaccctcccacggcgaggccaagccctgagactggactagcaaggtcgtgagtctctctgtcagctctccgcagcgaaggggcgcggggggcggggaccgtgcccgaccgtgccagctcccgccccggaagcggaagtgcaagcactgcggggtcctgtccagtgtgagcccgacccgagctccagtagttccgcccgctggtcatcgcgccctttcccctgccggtgtcctgctcgccgtccccgccatgctgtctctagactttttggacgatgtgcggcggatgaacaagcggcagctctattatcaagtcctaaattttggaatgattgtctcatcggcactaatgatctggaaggggttaatggtaataactggaagtgaaagtccgattgtagtggtgctcagtggcagcatggaacctgcatttcatagaggagatcttctctttctaacaaatcgagttgaagatcccatacgagtgggagaaattgttgtttttaggatagaaggaagagagattcctatagttcaccgagtcttgaagattcatgaaaagcaaaatgggcatatcaagtttttgaccaaaggagataataatgcggttgatgaccgaggcctctataaacaaggacaacattggctagagaaaaaagatgttgtggggagagccaggggatttgttccttatattggaattgtgacgatcctcatgaatgactatcctaaatttaagtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcattgtcacactttcaaatttttgtacatcagtgaatttttttatattaaaaggttgagccaa

SEQ ID NO: 436996 - DNA, 1009 bp, Homo sapiens
  misc_feature (23)..(23): n is a, c, g, or t
  misc_feature (69)..(69): n is a, c, g, or t
  misc_feature (72)..(73): n is a, c, g, or t
  misc_feature (76)..(78): n is a, c, g, or t
tctgtatctattgttggattagntgctgtttttcatagtgacgagaagaaacaagccttatatggtacnctnnatnnngttagtgacgatcctcatgaatgactatcctaaatttaagtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcattgtcacactttcaaatttttgtacatcagtgaatttttttatattaaaaggttgagccaaagcccccagtgtttgtattttgaagccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaaaaaaaaaaaaaagaaaacaaaaaaaaaaagaaaaaaaaaagaaagaaaaataacgaaaaaagataaaaacaaacacacggggggggcggggcggcgtagagaaatactcccccaggggggcggcgccgcagcgaattcatcagcggcaccaccaacaggtctttttgttaaaaaaaaggggggcccccactataggaaggcgccgggcattaaaaatgaacagcagaacggagggccgggggctattaaaaccagcgggcgggggggggacaaaaaccgctgctacggggggggcctcttggagggagcgaacaccccacacatggcggggggggaaacaaatgtggggcagaaaacatacgcaa

SEQ ID NO: 436997 - DNA, 498 bp, Homo sapiens
  misc_feature (16)..(16): n is a, c, g, or t
  misc_feature (48)..(48): n is a, c, g, or t
  misc_feature (50)..(51): n is a, c, g, or t
tagtcggtaccgacgntctctctgtggggagagccagggattttatcngnnaacagttcagtggaggacaggaattatttgttccttatattggaattgtgacgatcctcatgaatgactatcctaaatttaagtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcattgtcacactttcaaatttttgtacatcagtgaatttttttatattaaaaggttgagccaaacagagaccccacagagtgagcgt

SEQ ID NO: 436998 - DNA, 458 bp, Homo sapiens
  misc_feature (23)..(23): n is a, c, g, or t
  misc_feature (69)..(69): n is a, c, g, or t
  misc_feature (72)..(73): n is a, c, g, or t
  misc_feature (76)..(78): n is a, c, g, or t
tctgtatctattgttggattagntgctgtttttcatagtgacgagaagaaacaagccttatatggtacnctnnatnnngttagtgacgatcctcatgaatgactatcctaaatttaagtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcattgtcacactttcaaatttttgtacatcagtgaatttttttatattaaaaggttgagccaa

SEQ ID NO: 436999 - DNA, 560 bp, Homo sapiens
gttatgatgataaacctagcccctagcactgtatcaacatgtagcattagagtcaccacctggagatctaagaccttggctctatctggtgctggttctgccacacagaaaccatgtaccttgggcatgatcatctgtttcctcatctctaaaatggtgatattcctaactttcctatcacttgggcttttgcaaggatcaaatagggcagtatatagaaatggactttgtgaattgaaaattagtattctatagaagatattgataatattcagtgagtgacaacagctgctttacatcggaaattctgtgataatcagttttttgtttgttttagatttgttccttatattggaattgtgacgatcctcatgaatgactatcctaaatttaaggtaagagtctgtattatttgttttattaaaaaatgtaatcttttgggccaggcacagtggctcaagcctgtaatcccagcactctgggaggccgaggtgagtggatcgcttgagcccaggagttcaagaccagcctgggcaacatagcgaaaccccgtctctatt

SEQ ID NO: 437000 - DNA, 1884 bp, Homo sapiens
  misc_feature (427)..(427): n is a, c, g, or t
  misc_feature (516)..(516): n is a, c, g, or t
gaaggtggcagagcagcctccccaactaagcctgggtcgccgcctcggtgaagggccgcggggccgagcgcgggaagtggcgtccagtcggtttttggcaggcgagagccagagcgtgagaaccctcccacggcgaggccaagccctgagactggactagcaaggtcgtgagtctctctgtcagctctccgcagcgaaggggcgcggggggcggggaccgtgcccgaccgtgccagctcccgccccggaagcggaagtgcaagcactgcggggtcctgtccagtgtgagcccgacccgagctccagtagttccgcccgctggtcatcgcgccctttcccctgccggtgtcctgctcgccgtccccgccatgctgtctctagactttttggacgatgtgcggcggatgaacaagcggcaggtacaatnagagaaatgcaaagatagttaagaaagactcggccttcaaggagcctaaatgtgtagaaaaggactaaggcaaaacaataacttttttnagctcttgccatgtgtgaagcactttatacacctgtaagctctattatcaagtcctaaattttggaatgattgtctcatcggcactaatgatctggaaggggttaatggtaataactggaagtgaaagtccgattgtagtggtgctcagtggcagcatggaacctgcatttcatagaggagatcttctctttctaacaaatcgagttgaagatcccatacgagtgggagaaattgttgtttttaggatagaaggaagagagattcctatagttcaccgagtcttgaagattcatgaaaagcaaaatgggcatatcaagtttttgaccaaaggagataataatgcggttgatgaccgaggcctctataaacaaggacaacattggctagagaaaaaagatgttgtggggagagccaggggatttgttccttatattggaattgtgacgatcctcatgaatgactatcctaaatttaagtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcattgtcacactttcaaatttttgtacatcagtgaatttttttatattaaaaggttgagccaaagcccccagtgtttgtattttgaagccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaaaaaaaaaaaaaagaaaacaaaaaaaaaaagaaaaaaaaaagaaagaaaaataacgaaaaaagataaaaacaaacacacggggggggcggggcggcgtagagaaatactcccccaggggggcggcgccgcagcgaattcatcagcggcaccaccaacaggtctttttgttaaaaaaaaggggggcccccactataggaaggcgccgggcattaaaaatgaacagcagaacggagggccgggggctattaaaaccagcgggcgggggggggacaaaaaccgctgctacggggggggcctcttggagggagcgaacaccccacacatggcggggggggaaacaaatgtggggcagaaaacatacgcaa

SEQ ID NO: 437001 - DNA, 1562 bp, Homo sapiens
gaaggtggcagagcagcctccccaactaagcctgggtcgccgcctcggtgaagggccgcggggccgagcgcgggaagtggcgtccagtcggtttttggcaggcgagagccagagcgtgagaaccctcccacggcgaggccaagccctgagactggactagcaaggtcgtgagtctctctgtcagctctccgcagcgaaggggcgcggggggcggggaccgtgcccgaccgtgccagctcccgccccggaagcggaagtgcaagcactgcggggtcctgtccagtgtgagcccgacccgagctccagtagttccgcccgctggtcatcgcgccctttcccctgccggtgtcctgctcgccgtccccgccatgctgtctctagactttttggacgatgtgcggcggatgaacaagcggcagctctattatcaagtcctaaattttggaatgattgtctcatcggcactaatgatctggaaggggttaatggtaataactggaagtgaaagtccgattgtagtggtgctcagtggcagcatggaacctgcatttcatagaggagatcttctctttctaacaaatcgagttgaagatcccatacgagtgggagaaattgttgtttttaggatagaaggaagagagattcctatagttcaccgagtcttgaagattcatgaaaagcaaaatgggcatatcaagtttttgaccaaaggagataataatgcggttgatgaccgaggcctctataaacaaggacaacattggctagagaaaaaagatgttgtggggagagccaggggatttgttccttatattggaattgtgacgatcctcatgaatgactatcctaaatttaagtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcattgtcacactttcaaatttttgtacatcagtgaatttttttatattaaaaggttgagccaaaaaaaaaaaaaagaaaacaaaaaaaaaaagaaaaaaaaaagaaagaaaaataacgaaaaaagataaaaacaaacacacggggggggcggggcggcgtagagaaatactcccccaggggggcggcgccgcagcgaattcatcagcggcaccaccaacaggtctttttgttaaaaaaaaggggggcccccactataggaaggcgccgggcattaaaaatgaacagcagaacggagggccgggggctattaaaaccagcgggcgggggggggacaaaaaccgctgctacggggggggcctcttggagggagcgaacaccccacacatggcggggggggaaacaaatgtggggcagaaaacatacgcaa

SEQ ID NO: 437002 - DNA, 1123 bp, Homo sapiens
cgctgatagaggatccccatcgcgcaatcacgtagagtctgaagatcatgaaaagcaaaatgggcatatcaagtttttgaccaaaggagataataatgcggttgatgaccgaggcctctataaacaaggacaacattggctagagaaaaaagatgttgtggggagagccaggggatttgttccttatattggaattgtgacgatcctcatgaatgactatcctaaatttaagtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcattgtcacactttcaaatttttgtacatcagtgaatttttttatattaaaaggttgagccaaagcccccagtgtttgtattttgaagccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaaaaaaaaaaaaaagaaaacaaaaaaaaaaagaaaaaaaaaagaaagaaaaataacgaaaaaagataaaaacaaacacacggggggggcggggcggcgtagagaaatactcccccaggggggcggcgccgcagcgaattcatcagcggcaccaccaacaggtctttttgttaaaaaaaaggggggcccccactataggaaggcgccgggcattaaaaatgaacagcagaacggagggccgggggctattaaaaccagcgggcgggggggggacaaaaaccgctgctacggggggggcctcttggagggagcgaacaccccacacatggcggggggggaaacaaatgtggggcagaaaacatacgcaa

SEQ ID NO: 437003 - DNA, 1786 bp, Homo sapiens
gaaggtggcagagcagcctccccaactaagcctgggtcgccgcctcggtgaagggccgcggggccgagcgcgggaagtggcgtccagtcggtttttggcaggcgagagccagagcgtgagaaccctcccacggcgaggccaagccctgagactggactagcaaggtcgtgagtctctctgtcagctctccgcagcgaaggggcgcggggggcggggaccgtgcccgaccgtgccagctcccgccccggaagcggaagtgcaagcactgcggggtcctgtccagtgtgagcccgacccgagctccagtagttccgcccgctggtcatcgcgccctttcccctgccggtgtcctgctcgccgtccccgccatgctgtctctagactttttggacgatgtgcggcggatgaacaagcggcagctctattatcaagtcctaaattttggaatgattgtctcatcggcactaatgatctggaaggggttaatggtaataactggaagtgaaagtccgattgtagtggtgctcagtggcagcatggaacctgcatttcatagaggagatcttctctttctaacaaatcgagttgaagatcccatacgagtgggagaaattgttgtttttaggatagaaggaagagagattcctatagttcaccgagtcttgaagattcatgaaaagcaaaatgggcatatcaagtttttgaccaaaggagataataatgcggttgatgaccgaggcctctataaacaaggacaacattggctagagaaaaaagatgttgtggggagagccaggggattttatcaggagaacagttcagtggaggacaggaattatttgttccttatattggaattgtgacgatcctcatgaatgactatcctaaatttaagtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcattgtcacactttcaaatttttgtacatcagtgaatttttttatattaaaaggttgagccaaagcccccagtgtttgtattttgaagccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaaaaaaaaaaaaaagaaaacaaaaaaaaaaagaaaaaaaaaagaaagaaaaataacgaaaaaagataaaaacaaacacacggggggggcggggcggcgtagagaaatactcccccaggggggcggcgccgcagcgaattcatcagcggcaccaccaacaggtctttttgttaaaaaaaaggggggcccccactataggaaggcgccgggcattaaaaatgaacagcagaacggagggccgggggctattaaaaccagcgggcgggggggggacaaaaaccgctgctacggggggggcctcttggagggagcgaacaccccacacatggcggggggggaaacaaatgtggggcagaaaacatacgcaa

SEQ ID NO: 437004 - DNA, 1286 bp, Homo sapiens
gttatgatgataaacctagcccctagcactgtatcaacatgtagcattagagtcaccacctggagatctaagaccttggctctatctggtgctggttctgccacacagaaaccatgtaccttgggcatgatcatctgtttcctcatctctaaaatggtgatattcctaactttcctatcacttgggcttttgcaaggatcaaatagggcagtatatagaaatggactttgtgaattgaaaattagtattctatagaagatattgataatattcagtgagtgacaacagctgctttacatcggaaattctgtgataatcagttttttgtttgttttagatttgttccttatattggaattgtgacgatcctcatgaatgactatcctaaatttaagtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcattgtcacactttcaaatttttgtacatcagtgaatttttttatattaaaaggttgagccaaagcccccagtgtttgtattttgaagccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaaaaaaaaaaaaaagaaaacaaaaaaaaaaagaaaaaaaaaagaaagaaaaataacgaaaaaagataaaaacaaacacacggggggggcggggcggcgtagagaaatactcccccaggggggcggcgccgcagcgaattcatcagcggcaccaccaacaggtctttttgttaaaaaaaaggggggcccccactataggaaggcgccgggcattaaaaatgaacagcagaacggagggccgggggctattaaaaccagcgggcgggggggggacaaaaaccgctgctacggggggggcctcttggagggagcgaacaccccacacatggcggggggggaaacaaatgtggggcagaaaacatacgcaa

SEQ ID NO: 437005 - DNA, 1714 bp, Homo sapiens
gaaggtggcagagcagcctccccaactaagcctgggtcgccgcctcggtgaagggccgcggggccgagcgcgggaagtggcgtccagtcggtttttggcaggcgagagccagagcgtgagaaccctcccacggcgaggccaagccctgagactggactagcaaggtcgtgagtctctctgtcagctctccgcagcgaaggggcgcggggggcggggaccgtgcccgaccgtgccagctcccgccccggaagcggaagtgcaagcactgcggggtcctgtccagtgtgagcccgacccgagctccagtagttccgcccgctggtcatcgcgccctttcccctgccggtgtcctgctcgccgtccccgccatgctgtctctagactttttggacgatgtgcggcggatgaacaagcggcagctctattatcaagtcctaaattttggaatgattgtctcatcggcactaatgatctggaaggggttaatggtaataactggaagtgaaagtccgattgtagtggtgctcagtggcagcatggaacctgcatttcatagaggagatcttctctttctaacaaatcgagttgaagatcccatacgagtgggagaaattgttgtttttaggatagaaggaagagagattcctatagttcaccgagtcttgaagattcatgaaaagcaaaatgggcatatcaagtttttgaccaaaggagataataatgcggttgatgaccgaggcctctataaacaaggacaacattggctagagaaaaaagatgttgtggggagagccaggggatttgttccttatattggaattgtgacgatcctcatgaatgactatcctaaatttaagtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataatttgaatttttttatattaaaaggttgagccaaagcccccagtgtttgtattttgaagccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaaaaaaaaaaaaaagaaaacaaaaaaaaaaagaaaaaaaaaagaaagaaaaataacgaaaaaagataaaaacaaacacacggggggggcggggcggcgtagagaaatactcccccaggggggcggcgccgcagcgaattcatcagcggcaccaccaacaggtctttttgttaaaaaaaaggggggcccccactataggaaggcgccgggcattaaaaatgaacagcagaacggagggccgggggctattaaaaccagcgggcgggggggggacaaaaaccgctgctacggggggggcctcttggagggagcgaacaccccacacatggcggggggggaaacaaatgtggggcagaaaacatacgcaa

SEQ ID NO: 437006 - DNA, 1248 bp, Homo sapiens
gaaggtggcagagcagcctccccaactaagcctgggtcgccgcctcggtgaagggccgcggggccgagcgcgggaagtggcgtccagtcggtttttggcaggcgagagccagagcgtgagaaccctcccacggcgaggccaagccctgagactggactagcaaggtcgtgagtctctctgtcagctctccgcagcgaaggggcgcggggggcggggaccgtgcccgaccgtgccagctcccgccccggaagcggaagtgcaagcactgcggggtcctgtccagtgtgagcccgacccgagctccagtagttccgcccgctggtcatcgcgccctttcccctgccggtgtcctgctcgccgtccccgccatgctgtctctagactttttggacgatgtgcggcggatgaacaagcggcagctctattatcaagtcctaaattttggaatgattgtctcatcggcactaatgatctggaaggggttaatggtaataactggaagtgaaagtccgattgtagtggtgctcagtggcagcatggaacctgcatttcatagaggagatcttctctttctaacaaatcgagttgaagatcccatacgagtgggagaaattgttgtttttaggatagaaggaagagagattcctatagttcaccgagtcttgaagattcatgaaaagcaaaatgggcatatcaagtttttgaccaaaggagataataatgcggttgatgaccgaggcctctataaacaaggacaacattggctagagaaaaaagatgttgtggggagagccaggggatttgttccttatattggaattgtgacgatcctcatgaatgactatcctaaatttaagtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtgtctaactgatgatcctcatgaatgactatcctatatattagtatgcagtgctcttatggctgggtttattcgtgctggtacatcgtgagtaagaagcctgccttgctgttcct

SEQ ID NO: 437007 - DNA, 979 bp, Homo sapiens
  misc_feature (945)..(945): n is a, c, g, or t
gaaggtggcagagcagcctccccaactaagcctgggtcgccgcctcggtgaagggccgcggggccgagcgcgggaagtggcgtccagtcggtttttggcaggcgagagccagagcgtgagaaccctcccacggcgaggccaagccctgagactggactagcaaggtcgtgagtctctctgtcagctctccgcagcgaaggggcgcggggggcggggaccgtgcccgaccgtgccagctcccgccccggaagcggaagtgcaagcactgcggggtcctgtccagtgtgagcccgacccgagctccagtagttccgcccgctggtcatcgcgccctttcccctgccggtgtcctgctcgccgtccccgccatgctgtctctagactttttggacgatgtgcggcggatgaacaagcggcagctctattatcaagtcctaaattttggaatgattgtctcatcggcactaatgatctggaaggggttaatggtaataactggaagtgaaagtccgattgtagtggtgctcagtggcagcatggaacctgcatttcatagaggagatcttctctttctaacaaatcgagttgaagatcccatacgagtgggagaaattgttgtttttaggatagaaggaagagagattcctatagttcaccgagtcttgaagattcatgaaaagcaaaatgggcatatcaagtttttgaccaaaggagataataatgcggttgatgaccgaggcctctataaacaaggacaacattggctagagaaaaaagatgttgtggggagagccaggggatttgttccttatattggaattgtgacgatcctcatgaatgactatcctaaatttaagtatgcagttctctttttgctgggtttattcgtgctggttcatcgtgagtaagaagcctgccttgctgttcctgggaagatgccataanagccgccgatgaggatcctctagagctgaccgca

SEQ ID NO: 437008 - DNA, 1080 bp, Homo sapiens
tctgtcgcccaggcttgagtgcagtggcgtgatctcggctcactgcaacctccgcctcctgggttcaagtgattctcctgcctcagcctcctgagtagctgggactacaggcacccaccaccatgcccagcttatttttgtatttttagtaaagacagggtttcgccatgttggccaggctggtctcgaacttctgacctcaggtgatccgcccaccttggcctcccaaagtgctgggattacaggcgtgagccaccgcgcctggcccgtctcttgttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcattgtcacactttcaaatttttgtacatcagtgaatttttttatattaaaaggttgagccaaagcccccagtgtttgtattttgaagccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaaaaaaaaaaaaaagaaaacaaaaaaaaaaagaaaaaaaaaagaaagaaaaataacgaaaaaagataaaaacaaacacacggggggggcggggcggcgtagagaaatactcccccaggggggcggcgccgcagcgaattcatcagcggcaccaccaacaggtctttttgttaaaaaaaaggggggcccccactataggaaggcgccgggcattaaaaatgaacagcagaacggagggccgggggctattaaaaccagcgggcgggggggggacaaaaaccgctgctacggggggggcctcttggagggagcgaacaccccacacatggcggggggggaaacaaatgtggggcagaaaacatacgcaa

SEQ ID NO: 437009 - DNA, 919 bp, Homo sapiens
tgaataatatagtaaatagagattgcatttaattaggagagtcattcttacgattgtaacgtaaataggataccgggctcgaatttgtagtgatgatcttatatctttgcggaggttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcattgtcacactttcaaatttttgtacatcagtgaatttttttatattaaaaggttgagccaaagcccccagtgtttgtattttgaagccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaaaaaaaaaaaaaagaaaacaaaaaaaaaaagaaaaaaaaaagaaagaaaaataacgaaaaaagataaaaacaaacacacggggggggcggggcggcgtagagaaatactcccccaggggggcggcgccgcagcgaattcatcagcggcaccaccaacaggtctttttgttaaaaaaaaggggggcccccactataggaaggcgccgggcattaaaaatgaacagcagaacggagggccgggggctattaaaaccagcgggcgggggggggacaaaaaccgctgctacggggggggcctcttggagggagcgaacaccccacacatggcggggggggaaacaaatgtggggcagaaaacatacgcaa

SEQ ID NO: 437010 - DNA, 503 bp, Homo sapiens
ctgttccttgacttgatgagccatttttccttctaaatgagttgaacatataaggtcatcttggctgttatctttataaatggcagaggaagatgatccagttctcatttgcatatctgaatatgtttagtgttttcagatgaagtgagaataagggcattgttttaaagttcattcttttatattctgtttgtcatttgaaattttaaaaggttaaggaattagtaacactgaccttttcaagatttaagcttctttgactagtgatacttgaaatggaactagttagtgaaggttaataactaaaaaaaaatcctttggcgtaactttttagtctgaggaaaccatattttgagaacaatacacatttctgttgatatagttgttagggtattgagtatactcccaaagtgatattttttattttgttgaatatctaattttgaaagtacatttaatctcatactttctttttgctgttatattcttctttcccttccagt

SEQ ID NO: 437011 - DNA, 1748 bp, Homo sapiens
gaaggtggcagagcagcctccccaactaagcctgggtcgccgcctcggtgaagggccgcggggccgagcgcgggaagtggcgtccagtcggtttttggcaggcgagagccagagcgtgagaaccctcccacggcgaggccaagccctgagactggactagcaaggtcgtgagtctctctgtcagctctccgcagcgaaggggcgcggggggcggggaccgtgcccgaccgtgccagctcccgccccggaagcggaagtgcaagcactgcggggtcctgtccagtgtgagcccgacccgagctccagtagttccgcccgctggtcatcgcgccctttcccctgccggtgtcctgctcgccgtccccgccatgctgtctctagactttttggacgatgtgcggcggatgaacaagcggcagctctattatcaagtcctaaattttggaatgattgtctcatcggcactaatgatctggaaggggttaatggtaataactggaagtgaaagtccgattgtagtggtgctcagtggcagcatggaacctgcatttcatagaggagatcttctctttctaacaaatcgagttgaagatcccatacgagtgggagaaattgttgtttttaggatagaaggaagagagattcctatagttcaccgagtcttgaagattcatgaaaagcaaaatgggcatatcaagtttttgaccaaaggagataataatgcggttgatgaccgaggcctctataaacaaggacaacattggctagagaaaaaagatgttgtggggagagccaggggatttgttccttatattggaattgtgacgatcctcatgaatgactatcctaaatttaagtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcattgtcacactttcaaatttttgtacatcagtgaatttttttatattaaaaggttgagccaaagcccccagtgtttgtattttgaagccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaaaaaaaaaaaaaagaaaacaaaaaaaaaaagaaaaaaaaaagaaagaaaaataacgaaaaaagataaaaacaaacacacggggggggcggggcggcgtagagaaatactcccccaggggggcggcgccgcagcgaattcatcagcggcaccaccaacaggtctttttgttaaaaaaaaggggggcccccactataggaaggcgccgggcattaaaaatgaacagcagaacggagggccgggggctattaaaaccagcgggcgggggggggacaaaaaccgctgctacggggggggcctcttggagggagcgaacaccccacacatggcggggggggaaacaaatgtggggcagaaaacatacgcaa

SEQ ID NO: 437012 - DNA, 1598 bp, Homo sapiens
gaaggtggcagagcagcctccccaactaagcctgggtcgccgcctcggtgaagggccgcggggccgagcgcgggaagtggcgtccagtcggtttttggcaggcgagagccagagcgtgagaaccctcccacggcgaggccaagccctgagactggactagcaaggtcgtgagtctctctgtcagctctccgcagcgaaggggcgcggggggcggggaccgtgcccgaccgtgccagctcccgccccggaagcggaagtgcaagcactgcggggtcctgtccagtgtgagcccgacccgagctccagtagttccgcccgctggtcatcgcgccctttcccctgccggtgtcctgctcgccgtccccgccatgctgtctctagactttttggacgatgtgcggcggatgaacaagcggcagctctattatcaagtcctaaattttggaatgattgtctcatcggcactaatgatctggaaggggttaatggtaataactggaagtgaaagtccgattgtagtggtgctcaggcaaaatgggcatatcaagtttttgaccaaaggagataataatgcggttgatgaccgaggcctctataaacaaggacaacattggctagagaaaaaagatgttgtggggagagccaggggatttgttccttatattggaattgtgacgatcctcatgaatgactatcctaaatttaagtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcattgtcacactttcaaatttttgtacatcagtgaatttttttatattaaaaggttgagccaaagcccccagtgtttgtattttgaagccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattgaaaaaaaaaaaaaagaaaacaaaaaaaaaaagaaaaaaaaaagaaagaaaaataacgaaaaaagataaaaacaaacacacggggggggcggggcggcgtagagaaatactcccccaggggggcggcgccgcagcgaattcatcagcggcaccaccaacaggtctttttgttaaaaaaaaggggggcccccactataggaaggcgccgggcattaaaaatgaacagcagaacggagggccgggggctattaaaaccagcgggcgggggggggacaaaaaccgctgctacggggggggcctcttggagggagcgaacaccccacacatggcggggggggaaacaaatgtggggcagaaaacatacgcaa

SEQ ID NO: 437013 - DNA, 1171 bp, Homo sapiens
gaaggtggcagagcagcctccccaactaagcctgggtcgccgcctcggtgaagggccgcggggccgagcgcgggaagtggcgtccagtcggtttttggcaggcgagagccagagcgtgagaaccctcccacggcgaggccaagccctgagactggactagcaaggtcgtgagtctctctgtcagctctccgcagcgaaggggcgcggggggcggggaccgtgcccgaccgtgccagctcccgccccggaagcggaagtgcaagcactgcggggtcctgtccagtgtgagcccgacccgagctccagtagttccgcccgctggtcatcgcgccctttcccctgccggtgtcctgctcgccgtccccgccatgctgtctctagactttttggacgatgtgcggcggatgaacaagcggcagctctattatcaagtcctaaattttggaatgattgtctcatcggcactaatgatctggaaggggttaatggtaataactggaagtgaaagtccgattgtagtggtgctcagtggcagcatggaacctgcatttcatagaggagatcttctctttctaacaaatcgagttgaagatcccatacgagtgggagaaattgttgtttttaggatagaaggaagagagattcctatagttcaccgagtcttgaagattcatgaaaagcaaaatgggcatatcaagtttttgaccaaaggagataataatgcggttgatgaccgaggcctctataaacaaggacaacattggctagagaaaaaagatgttgtggggagagccaggggatttgttccttatattggaattgtgacgatcctcatgaatgactatcctaaatttaagtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcatcgtcacatcgtcacttagacgggatcctctagac

SEQ ID NO: 437014 - DNA, 1277 bp, Homo sapiens
gaaggtggcagagcagcctccccaactaagcctgggtcgccgcctcggtgaagggccgcggggccgagcgcgggaagtggcgtccagtcggtttttggcaggcgagagccagagcgtgagaaccctcccacggcgaggccaagccctgagactggactagcaaggtcgtgagtctctctgtcagctctccgcagcgaaggggcgcggggggcggggaccgtgcccgaccgtgccagctcccgccccggaagcggaagtgcaagcactgcggggtcctgtccagtgtgagcccgacccgagctccagtagttccgcccgctggtcatcgcgccctttcccctgccggtgtcctgctcgccgtccccgccatgctgtctctagactttttggacgatgtgcggcggatgaacaagcggcagctctattatcaagtcctaaattttggaatgattgtctcatcggcactaatgatctggaaggggttaatggtaataactggaagtgaaagtccgattgtagtggtgctcagtggcagcatggaacctgcatttcatagaggagatcttctctttctaacaaatcgagttgaagatcccatacgagtgggagaaattgttgtttttaggatagaaggaagagagattcctatagttcaccgagtcttgaagattcatgaaaagcaaaatgggcatatcaagtttttgaccaaaggagataataatgcggttgatgaccgaggcctctataaacaaggacaacattggctagagaaaaaagatgttgtggggagagccaggggatttgttccttatattggaattgtgacgatcctcatgaatgactatcctaaatttaagtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcatcgtctgtctaagtgcgatggtgagagctaaggtcggggcggtgatgtagagggtgatggtagatgtggcgggttttaggggctctttggtgaagagttttatggcgtcagcgaagggttgtagtagtccgtaggggccta

SEQ ID NO: 437015 - DNA, 3781 bp, Homo sapiens
ctgtctgagcatttcactgcggagcctgagcgcgcctgcctgggaaaacactgcagcggtgctcggactcctcctgtccagcaggaggcgcggcccggcagctcccgcatgcgcagtgcgctcggtgtcagacggcccggatcccggttaccggcccctcgctcgctgctcgccagcccagactcggccctggcagtggcggctggcgattcggaccgatccgacctgggcggaggtggcccgcgccccgcggcatgagccggtgaccaagctcggggccgagcgggaggcagccgtggccgagccacagggatctgattcctcccagggggatgtcctgcgcctcagggtccggtggtggcctgcggcatcccttgcggtgccagaagccgtgggacgagtgtctttaatgttatagagctactcagagttgctgtttctccttgagatgcttttggagtgtgaggaagaggctgtctgtgtcattatgtgtgcgtcggtcaagtataatatccggggtcctgccctcatcccaagaatgaagaccaagcaccgaatctactatatcaccctcttctccattgtcctcctgggcctcattgccactggcatgtttcagttttggccccattctatcgagtcctcaaatgactggaatgtagagaagcgcagcatccgtgatgtgccggttgttaggctgccagccgacagtcccatcccagagcggggggatctcagttgcagaatgcacacgtgttttgatgtctatcgctgtggcttcaacccaaagaacaaaatcaaggtgtatatctatgctctgaaaaagtacgtggatgactttggcgtctctgtcagcaacaccatctcccgggagtataatgaactgctcatggccatctcagacagtgactactacactgatgacatcaaccgggcctgtctgtttgttccctccatcgatgtgcttaaccagaacacactgcgcatcaaggagacagcacaagcgatggcccagctctctaggtgggatcgaggtacgaatcacctgttgttcaacatgttgcctggaggtcccccagattataacacagccctggatgtccccagagacagggccctgttggctggtggcggcttttctacgtggacttaccggcaaggctacgatgtcagcattcctgtctatagtccactgtcagctgaggtggatcttccagagaaaggaccaggtccacggcaatacttcctcctgtcatctcaggtgggtctccatcctgagtacagagaggacctagaagccctccaggtcaaacatggagagtcagtgttagtactcgataaatgcaccaacctctcagagggtgtcctttctgtccgtaagcgctgccacaagcaccaggtcttcgattacccacaggtgctacaggaggctactttctgtgtggttcttcgtggagctcggctgggccaggcagtattgagcgatgtgttacaagctggctgtgtcccggttgtcattgcagactcctatattttgcctttctctgaagttcttgactggaagagagcatctgtggttgtaccagaagaaaagatgtcagatgtgtacagtattttgcagagcatcccccaaagacagattgaagaaatgcagagacaggcccggtggttctgggaagcgtacttccagtcaattaaagccattgccctggccaccctgcagattatcaatgaccggatctatccatatgctgccatctcctatgaagaatggaatgaccctcctgctgtgaagtggggcagcgtgagcaatccactcttcctcccgctgatcccaccacagtctcaagggttcaccgccatagtcctcacctacgaccgagtagagagcctcttccgggtcatcactgaagtgtccaaggtgcccagtctatccaaactacttgtcgtctggaataatcagaataaaaaccctccagaagattctctctggcccaaaatccgggttccattaaaagttgtgaggactgctgaaaacaagttaagtaaccgtttcttcccttatgatgaaatcgagacagaagctgttctggccattgatgatgatatcattatgctgacctctgacgagctgcaatttggttatgaggtctggcgggaatttcctgaccggttggtgggttacccgggtcgtctgcatctctgggaccatgagatgaataagtggaagtatgagtctgagtggacgaatgaagtgtccatggtgctcactggggcagctttttatcacaagtattttaattacctgtatacctacaaaatgcctggggatatcaagaactgggtagatgctcatatgaactgtgaagatattgccatgaacttcctggtggccaacgtcacgggaaaagcagttatcaaggtaaccccacgaaagaaattcaagtgtcctgagtgcacagccatagatgggctttcactagaccaaacacacatggtggagaggtcagagtgcatcaacaagtttgcttcagtcttcgggaccatgcctctcaaggtggtggaacaccgagctgaccctgtcctgtacaaagatgactttcctgagaagctgaagagcttccccaacattggcagcttatgaaacgtgtcattggtggaggtctgaatgtgaggctgggacagagggagagaacaaggcctcccagcactctgatgtcagagtagtaggttaagggtggaaggttgacctacttggatcttggcatgcacccacctaacccactttctcaagaacaagaacctagaatgaatatccaagcacctcgagctatgcaacctctgttcttgtatttcttatgatctctgatgggttcttctcgaaaatgccaagtggaagactttgtggcatgctccagatttaaatccagctgaggctccctttgttttcagttccatgtaacaatctggaaggaaacttcacggacaggaagactgctggagaagagaagcgtgttagcccatttgaggtctggggaatcatgtaaagggtacccagacctcacttttagttatttacatcaatgagttctttcagggaaccaaacccagaattcggtgcaaaagccaaacatcttggtgggatttgataaatgccttgggacctggagtgctgggcttgtgcacaggaagagcaccagccgctgagtcaggatcctgtcagttccatgagctattcctctttggtttggctttttgatatgattaaaattattttttattcctttttatactgtgtcttaaacaccaattcctgatagtccaaggaaccacctttctcccttgatatatttaactccgtctttggcctgacaacagtcttctgcccatgtctgggaacacacgccaggaggaatgtctgataccctctgcatcaagcgtaagaaggtcccaaatcataaccattttaagaacagatgactcagaaacctccagaggaatctgtttgcttcctgattagatccagtcaatgttttaaaggtattgtcagagaaaaacagagggtctgtactagccatgcaaggagtcgctctagctggtacccgtaaaagttgtgggattgtgaccccccatcccaaggggatgccaaaatttctctcattcttttggtataaacttaacattagccagggaggttctggctaacgttaaatgctgctatacaactgctttgcaacagttgctggtatatttaaatcattaaatttcagcatttactaat

SEQ ID NO: 437016 - DNA, 3459 bp, Homo sapiens
tccagcctgagtgacagagtgaaaccctgtctcaaaacaaaacaaaacaaaaaaaaaggttgaatagtcttttcaagtgtcatttgccatcctaaatacttggtttttcttatttctctccctggtgaccaggaggagtgtgaggaagaggctgtctgtgtcattatgtgtgcgtcggtcaagtataatatccggggtcctgccctcatcccaagaatgaagaccaagcaccgaatctactatatcaccctcttctccattgtcctcctgggcctcattgccactggcatgtttcagttttggccccattctatcgagtcctcaaatgactggaatgtagagaagcgcagcatccgtgatgtgccggttgttaggctgccagccgacagtcccatcccagagcggggggatctcagttgcagaatgcacacgtgttttgatgtctatcgctgtggcttcaacccaaagaacaaaatcaaggtgtatatctatgctctgaaaaagtacgtggatgactttggcgtctctgtcagcaacaccatctcccgggagtataatgaactgctcatggccatctcagacagtgactactacactgatgacatcaaccgggcctgtctgtttgttccctccatcgatgtgcttaaccagaacacactgcgcatcaaggagacagcacaagcgatggcccagctctctaggtgggatcgaggtacgaatcacctgttgttcaacatgttgcctggaggtcccccagattataacacagccctggatgtccccagagacagggccctgttggctggtggcggcttttctacgtggacttaccggcaaggctacgatgtcagcattcctgtctatagtccactgtcagctgaggtggatcttccagagaaaggaccaggtccacggcaatacttcctcctgtcatctcaggtgggtctccatcctgagtacagagaggacctagaagccctccaggtcaaacatggagagtcagtgttagtactcgataaatgcaccaacctctcagagggtgtcctttctgtccgtaagcgctgccacaagcaccaggtcttcgattacccacaggtgctacaggaggctactttctgtgtggttcttcgtggagctcggctgggccaggcagtattgagcgatgtgttacaagctggctgtgtcccggttgtcattgcagactcctatattttgcctttctctgaagttcttgactggaagagagcatctgtggttgtaccagaagaaaagatgtcagatgtgtacagtattttgcagagcatcccccaaagacagattgaagaaatgcagagacaggcccggtggttctgggaagcgtacttccagtcaattaaagccattgccctggccaccctgcagattatcaatgaccggatctatccatatgctgccatctcctatgaagaatggaatgaccctcctgctgtgaagtggggcagcgtgagcaatccactcttcctcccgctgatcccaccacagtctcaagggttcaccgccatagtcctcacctacgaccgagtagagagcctcttccgggtcatcactgaagtgtccaaggtgcccagtctatccaaactacttgtcgtctggaataatcagaataaaaaccctccagaagattctctctggcccaaaatccgggttccattaaaagttgtgaggactgctgaaaacaagttaagtaaccgtttcttcccttatgatgaaatcgagacagaagctgttctggccattgatgatgatatcattatgctgacctctgacgagctgcaatttggttatgaggtctggcgggaatttcctgaccggttggtgggttacccgggtcgtctgcatctctgggaccatgagatgaataagtggaagtatgagtctgagtggacgaatgaagtgtccatggtgctcactggggcagctttttatcacaagtattttaattacctgtatacctacaaaatgcctggggatatcaagaactgggtagatgctcatatgaactgtgaagatattgccatgaacttcctggtggccaacgtcacgggaaaagcagttatcaaggtaaccccacgaaagaaattcaagtgtcctgagtgcacagccatagatgggctttcactagaccaaacacacatggtggagaggtcagagtgcatcaacaagtttgcttcagtcttcgggaccatgcctctcaaggtggtggaacaccgagctgaccctgtcctgtacaaagatgactttcctgagaagctgaagagcttccccaacattggcagcttatgaaacgtgtcattggtggaggtctgaatgtgaggctgggacagagggagagaacaaggcctcccagcactctgatgtcagagtagtaggttaagggtggaaggttgacctacttggatcttggcatgcacccacctaacccactttctcaagaacaagaacctagaatgaatatccaagcacctcgagctatgcaacctctgttcttgtatttcttatgatctctgatgggttcttctcgaaaatgccaagtggaagactttgtggcatgctccagatttaaatccagctgaggctccctttgttttcagttccatgtaacaatctggaaggaaacttcacggacaggaagactgctggagaagagaagcgtgttagcccatttgaggtctggggaatcatgtaaagggtacccagacctcacttttagttatttacatcaatgagttctttcagggaaccaaacccagaattcggtgcaaaagccaaacatcttggtgggatttgataaatgccttgggacctggagtgctgggcttgtgcacaggaagagcaccagccgctgagtcaggatcctgtcagttccatgagctattcctctttggtttggctttttgatatgattaaaattattttttattcctttttatactgtgtcttaaacaccaattcctgatagtccaaggaaccacctttctcccttgatatatttaactccgtctttggcctgacaacagtcttctgcccatgtctgggaacacacgccaggaggaatgtctgataccctctgcatcaagcgtaagaaggtcccaaatcataaccattttaagaacagatgactcagaaacctccagaggaatctgtttgcttcctgattagatccagtcaatgttttaaaggtattgtcagagaaaaacagagggtctgtactagccatgcaaggagtcgctctagctggtacccgtaaaagttgtgggattgtgaccccccatcccaaggggatgccaaaatttctctcattcttttggtataaacttaacattagccagggaggttctggctaacgttaaatgctgctatacaactgctttgcaacagttgctggtatatttaaatcattaaatttcagcatttactaat

SEQ ID NO: 437017 - DNA, 3539 bp, Homo sapiens
gcgcggtttaccggtccctcgactcggtgctcaccagcgcatgactcttgccctgtgcagtgggggctggccattcgaaccgattcgaacgtgtagtcgcgatgtgagctgcagtgcccccggcaagcatgtagccgggtttaccaaagcatcgggagtccacggagtggtcgtaggctagggctctcgtccgaggaacgatgtgatcgatatacgagtgtgaggaagaggctgtctgtgtcattatgtgtgcgtcggtcaagtataatatccggggtcctgccctcatcccaagaatgaagaccaagcaccgaatctactatatcaccctcttctccattgtcctcctgggcctcattgccactggcatgtttcagttttggccccattctatcgagtcctcaaatgactggaatgtagagaagcgcagcatccgtgatgtgccggttgttaggctgccagccgacagtcccatcccagagcggggggatctcagttgcagaatgcacacgtgttttgatgtctatcgctgtggcttcaacccaaagaacaaaatcaaggtgtatatctatgctctgaaaaagtacgtggatgactttggcgtctctgtcagcaacaccatctcccgggagtataatgaactgctcatggccatctcagacagtgactactacactgatgacatcaaccgggcctgtctgtttgttccctccatcgatgtgcttaaccagaacacactgcgcatcaaggagacagcacaagcgatggcccagctctctaggtgggatcgaggtacgaatcacctgttgttcaacatgttgcctggaggtcccccagattataacacagccctggatgtccccagagacagggccctgttggctggtggcggcttttctacgtggacttaccggcaaggctacgatgtcagcattcctgtctatagtccactgtcagctgaggtggatcttccagagaaaggaccaggtccacggcaatacttcctcctgtcatctcaggtgggtctccatcctgagtacagagaggacctagaagccctccaggtcaaacatggagagtcagtgttagtactcgataaatgcaccaacctctcagagggtgtcctttctgtccgtaagcgctgccacaagcaccaggtcttcgattacccacaggtgctacaggaggctactttctgtgtggttcttcgtggagctcggctgggccaggcagtattgagcgatgtgttacaagctggctgtgtcccggttgtcattgcagactcctatattttgcctttctctgaagttcttgactggaagagagcatctgtggttgtaccagaagaaaagatgtcagatgtgtacagtattttgcagagcatcccccaaagacagattgaagaaatgcagagacaggcccggtggttctgggaagcgtacttccagtcaattaaagccattgccctggccaccctgcagattatcaatgaccggatctatccatatgctgccatctcctatgaagaatggaatgaccctcctgctgtgaagtggggcagcgtgagcaatccactcttcctcccgctgatcccaccacagtctcaagggttcaccgccatagtcctcacctacgaccgagtagagagcctcttccgggtcatcactgaagtgtccaaggtgcccagtctatccaaactacttgtcgtctggaataatcagaataaaaaccctccagaagattctctctggcccaaaatccgggttccattaaaagttgtgaggactgctgaaaacaagttaagtaaccgtttcttcccttatgatgaaatcgagacagaagctgttctggccattgatgatgatatcattatgctgacctctgacgagctgcaatttggttatgaggtctggcgggaatttcctgaccggttggtgggttacccgggtcgtctgcatctctgggaccatgagatgaataagtggaagtatgagtctgagtggacgaatgaagtgtccatggtgctcactggggcagctttttatcacaagtattttaattacctgtatacctacaaaatgcctggggatatcaagaactgggtagatgctcatatgaactgtgaagatattgccatgaacttcctggtggccaacgtcacgggaaaagcagttatcaaggtaaccccacgaaagaaattcaagtgtcctgagtgcacagccatagatgggctttcactagaccaaacacacatggtggagaggtcagagtgcatcaacaagtttgcttcagtcttcgggaccatgcctctcaaggtggtggaacaccgagctgaccctgtcctgtacaaagatgactttcctgagaagctgaagagcttccccaacattggcagcttatgaaacgtgtcattggtggaggtctgaatgtgaggctgggacagagggagagaacaaggcctcccagcactctgatgtcagagtagtaggttaagggtggaaggttgacctacttggatcttggcatgcacccacctaacccactttctcaagaacaagaacctagaatgaatatccaagcacctcgagctatgcaacctctgttcttgtatttcttatgatctctgatgggttcttctcgaaaatgccaagtggaagactttgtggcatgctccagatttaaatccagctgaggctccctttgttttcagttccatgtaacaatctggaaggaaacttcacggacaggaagactgctggagaagagaagcgtgttagcccatttgaggtctggggaatcatgtaaagggtacccagacctcacttttagttatttacatcaatgagttctttcagggaaccaaacccagaattcggtgcaaaagccaaacatcttggtgggatttgataaatgccttgggacctggagtgctgggcttgtgcacaggaagagcaccagccgctgagtcaggatcctgtcagttccatgagctattcctctttggtttggctttttgatatgattaaaattattttttattcctttttatactgtgtcttaaacaccaattcctgatagtccaaggaaccacctttctcccttgatatatttaactccgtctttggcctgacaacagtcttctgcccatgtctgggaacacacgccaggaggaatgtctgataccctctgcatcaagcgtaagaaggtcccaaatcataaccattttaagaacagatgactcagaaacctccagaggaatctgtttgcttcctgattagatccagtcaatgttttaaaggtattgtcagagaaaaacagagggtctgtactagccatgcaaggagtcgctctagctggtacccgtaaaagttgtgggattgtgaccccccatcccaaggggatgccaaaatttctctcattcttttggtataaacttaacattagccagggaggttctggctaacgttaaatgctgctatacaactgctttgcaacagttgctggtatatttaaatcattaaatttcagcatttactaat

SEQ ID NO: 437018 - DNA, 3438 bp, Homo sapiens
ctgtctgagcatttcactgcggagcctgagcgcgcctgcctgggaaaacactgcagcggtgctcggactcctcctgtccagcaggaggcgcggcccggcagctcccgcatgcgcagtgcgctcggtgtcagacggcccggatcccggttaccggcccctcgctcgctgctcgccagcccagactcggccctggcagtggcggctggcgattcggaccgatccgacctgggcggaggtggcccgcgccccgcggcatgagccggtgaccaagctcggggccgagcgggaggcagccgtggccgaggagtgtgaggaagaggctgtctgtgtcattatgtgtgcgtcggtcaagtataatatccggggtcctgccctcatcccaagaatgaagaccaagcaccgaatctactatatcaccctcttctccattgtcctcctgggcctcattgccactggcatgtttcagttttggccccattctatcgagtcctcaaatgactggaatgtagagaagcgcagcatccgtgatgtgccggttgttaggctgccagccgacagtcccatcccagagcggggggatctcagttgcagaatgcacacgtgttttgatgtctatcgctgtggcttcaacccaaagaacaaaatcaaggtgtatatctatgctctgaaaaagtacgtggatgactttggcgtctctgtcagcaacaccatctcccgggagtataatgaactgctcatggccatctcagacagtgactactacactgatgacatcaaccgggcctgtctgtttgttccctccatcgatgtgcttaaccagaacacactgcgcatcaaggagacagcacaagcgatggcccagctctctaggtgggatcgaggtacgaatcacctgttgttcaacatgttgcctggaggtcccccagattataacacagccctggatgtccccagagacagggccctgttggctggtggcggcttttctacgtggacttaccggcaaggctacgatgtcagcattcctgtctatagtccactgtcagctgaggtggatcttccagagaaaggaccaggtccacggcaatacttcctcctgtcatctcaggtgggtctccatcctgagtacagagaggacctagaagccctccaggtcaaacatggagagtcagtgttagtactcgataaatgcaccaacctctcagagggtgtcctttctgtccgtaagcgctgccacaagcaccaggtcttcgattacccacaggtgctacaggaggctactttctgtgtggttcttcgtggagctcggctgggccaggcagtattgagcgatgtgttacaagctggctgtgtcccggttgtcattgcagactcctatattttgcctttctctgaagttcttgactggaagagagcatctgtggttgtaccagaagaaaagatgtcagatgtgtacagtattttgcagagcatcccccaaagacagattgaagaaatgcagagacaggcccggtggttctgggaagcgtacttccagtcaattaaagccattgccctggccaccctgcagattatcaatgaccggatctatccatatgctgccatctcctatgaagaatggaatgaccctcctgctgtgattctctctggcccaaaatccgggttccattaaaagttgtgaggactgctgaaaacaagttaagtaaccgtttcttcccttatgatgaaatcgagacagaagctgttctggccattgatgatgatatcattatgctgacctctgacgagctgcaatttggttatgaggtctggcgggaatttcctgaccggttggtgggttacccgggtcgtctgcatctctgggaccatgagatgaataagtggaagtatgagtctgagtggacgaatgaagtgtccatggtgctcactggggcagctttttatcacaagtattttaattacctgtatacctacaaaatgcctggggatatcaagaactgggtagatgctcatatgaactgtgaagatattgccatgaacttcctggtggccaacgtcacgggaaaagcagttatcaaggtaaccccacgaaagaaattcaagtgtcctgagtgcacagccatagatgggctttcactagaccaaacacacatggtggagaggtcagagtgcatcaacaagtttgcttcagtcttcgggaccatgcctctcaaggtggtggaacaccgagctgaccctgtcctgtacaaagatgactttcctgagaagctgaagagcttccccaacattggcagcttatgaaacgtgtcattggtggaggtctgaatgtgaggctgggacagagggagagaacaaggcctcccagcactctgatgtcagagtagtaggttaagggtggaaggttgacctacttggatcttggcatgcacccacctaacccactttctcaagaacaagaacctagaatgaatatccaagcacctcgagctatgcaacctctgttcttgtatttcttatgatctctgatgggttcttctcgaaaatgccaagtggaagactttgtggcatgctccagatttaaatccagctgaggctccctttgttttcagttccatgtaacaatctggaaggaaacttcacggacaggaagactgctggagaagagaagcgtgttagcccatttgaggtctggggaatcatgtaaagggtacccagacctcacttttagttatttacatcaatgagttctttcagggaaccaaacccagaattcggtgcaaaagccaaacatcttggtgggatttgataaatgccttgggacctggagtgctgggcttgtgcacaggaagagcaccagccgctgagtcaggatcctgtcagttccatgagctattcctctttggtttggctttttgatatgattaaaattattttttattcctttttatactgtgtcttaaacaccaattcctgatagtccaaggaaccacctttctcccttgatatatttaactccgtctttggcctgacaacagtcttctgcccatgtctgggaacacacgccaggaggaatgtctgataccctctgcatcaagcgtaagaaggtcccaaatcataaccattttaagaacagatgactcagaaacctccagaggaatctgtttgcttcctgattagatccagtcaatgttttaaaggtattgtcagagaaaaacagagggtctgtactagccatgcaaggagtcgctctagctggtacccgtaaaagttgtgggattgtgaccccccatcccaaggggatgccaaaatttctctcattcttttggtataaacttaacattagccagggaggttctggctaacgttaaatgctgctatacaactgctttgcaacagttgctggtatatttaaatcattaaatttcagcatttactaat

SEQ ID NO: 437019 - DNA, 2576 bp, Homo sapiens
ctgtctgagcatttcactgcggagcctgagcgcgcctgcctgggaaaacactgcagcggtgctcggactcctcctgtccagcaggaggcgcggcccggcagctcccgcatgcgcagtgcgctcggtgtcagacggcccggatcccggttaccggcccctcgctcgctgctcgccagcccagactcggccctggcagtggcggctggcgattcggaccgatccgacctgggcggaggtggcccgcgccccgcggcatgagccggtgaccaagctcggggccgagcgggaggcagccgtggccgaggagtgtgaggaagaggctgtctgtgtcattatgtgtgcgtcggtcaagtataatatccggggtcctgccctcatcccaagaatgaagaccaagcaccgaatctactatatcaccctcttctccattgtcctcctgggcctcattgccactggcatgtttcagttttggccccattctatcgagtcctcaaatgactggaatgtagagaagcgcagcatccgtgatgtgccggttgttaggctgccagccgacagtcccatcccagagcggggggatctcagttgcagaatgcacacgtgttttgatgtctatcgctgtggcttcaacccaaagaacaaaatcaaggtgtatatctatgctctgaaaaagtacgtggatgactttggcgtctctgtcagcaacaccatctcccgggagtataatgaactgctcatggccatctcagacagtgactactacactgatgacatcaaccgggcctgtctgtttgttccctccatcgatgtgcttaaccagaacacactgcgcatcaaggagacagcacaagcgatggcccagctctctaggtgggatcgaggtacgaatcacctgttgttcaacatgttgcctggaggtcccccagattataacacagccctggatgtccccagagacagggccctgttggctggtggcggcttttctacgtggacttaccggcaaggctacgatgtcagcattcctgtctatagtccactgtcagctgaggtggatcttccagagaaaggaccaggtccacggcaatacttcctcctgtcatctcaggtgggtctccatcctgagtacagagaggacctagaagccctccaggtcaaacatggagagtcagtgttagtactcgataaatgcaccaacctctcagagggtgtcctttctgtccgtaagcgctgccacaagcaccaggtcttcgattacccacaggtgctacaggaggctactttctgtgtggttcttcgtggagctcggctgggccaggcagtattgagcgatgtgttacaagctggctgtgtcccggttgtcattgcagactcctatattttgcctttctctgaagttcttgactggaagagagcatctgtggttgtaccagaagaaaagatgtcagatgtgtacagtattttgcagagcatcccccaaagacagattgaagaaatgcagagacaggcccggtggttctgggaagcgtacttccagtcaattaaagccattgccctggccaccctgcagattatcaatgaccggatctatccatatgctgccatctcctatgaagaatggaatgaccctcctgctgtgaagtggggcagcgtgagcaatccactcttcctcccgctgatcccaccacagtctcaagggttcaccgccatagtcctcacctacgaccgagtagagagcctcttccgggtcatcactgaagtgtccaaggtgcccagtctatccaaactacttgtcgtctggaataatcagaataaaaaccctccagaagattctctctggcccaaaatccgggttccattaaaagttgtgaggactgctgaaaacaagttaagtaaccgtttcttcccttatgatgaaatcgagacagaagctgttctggccattgatgatgatatcattatgctgacctctgacgagctgcaatttggttatgaggtctgagtcaggatcctgtcagttccatgagctattcctctttggtttggctttttgatatgattaaaattattttttattcctttttatactgtgtcttaaacaccaattcctgatagtccaaggaaccacctttctcccttgatatatttaactccgtctttggcctgacaacagtcttctgcccatgtctgggaacacacgccaggaggaatgtctgataccctctgcatcaagcgtaagaaggtcccaaatcataaccattttaagaacagatgactcagaaacctccagaggaatctgtttgcttcctgattagatccagtcaatgttttaaaggtattgtcagagaaaaacagagggtctgtactagccatgcaaggagtcgctctagctggtacccgtaaaagttgtgggattgtgaccccccatcccaaggggatgccaaaatttctctcattcttttggtataaacttaacattagccagggaggttctggctaacgttaaatgctgctatacaactgctttgcaacagttgctggtatatttaaatcattaaatttcagcatttactaat

SEQ ID NO: 437020 - DNA, 1808 bp, Homo sapiens
ctgtctgagcatttcactgcggagcctgagcgcgcctgcctgggaaaacactgcagcggtgctcggactcctcctgtccagcaggaggcgcggcccggcagctcccgcatgcgcagtgcgctcggtgtcagacggcccggatcccggttaccggcccctcgctcgctgctcgccagcccagactcggccctggcagtggcggctggcgattcggaccgatccgacctgggcggaggtggcccgcgccccgcggcatgagccggtgaccaagctcggggccgagcgggaggcagccgtggccgaggagtgtgaggaagaggctgtctgtgtcattatgtgtgcgtcggtcaagtataatatccggggtcctgccctcatcccaagaatgaagaccaagcaccgaatctactatatcaccctcttctccattgtcctcctgggcctcattgccactggcatgtttcagttttggccccattctatcgagtcctcaaatgactggaatgtagagaagcgcagcatccgtgatgtgccggttgttaggctgccagccgacagtcccatcccagagcggggggatctcagttgcagaatgcacacgtgttttgatgtctatcgctgtggcttcaacccaaagaacaaaatcaaggtgtatatctatgctctgaaaaagtacgtggatgactttggcgtctctgtcagcaacaccatctcccgggagtataatgaactgctcatggccatctcagacagtgactactacactgatgacatcaaccgggcctgtctgtttgttccctccatcgatgtgcttaaccagaacacactgcgcatcaaggagacagcacaagcgatggcccagctctctaggtgggatcgaggtacgaatcacctgttgttcaacatgttgcctggaggtcccccagattataacacagccctggatgtccccagagacagggccctgttggctggtggcggcttttctacgtggacttaccggcaaggctacgatgtcagcattcctgtctatagtccactgtcagctgaggtggatcttccagagaaaggaccaggtccacggcaatacttcctcctgtcatctcaggtgggtctccatcctgagtacagagaggacctagaagccctccaggtcaaacatggagagtcagtgttagtactcgataaatgcaccaacctctcagagggtgtcctttctgtccgtaagcgctgccacaagcaccaggtcttcgattacccacaggtgctacaggaggctactttctgtgtggttcttcgtggagctcggctgggccaggcagtattgagcgatgtgttacaagctggctgtgtcccggttgtcattgcagactcctatattttgcctttctctgaagttcttgactggaagagagcatctgtggttgtaccagaagaaaagatgtcagatgtgtacagtattttgcagagcatcccccaaagacagattgaagaaatgcagagacaggcccggtggttctgggaagcgtacttccagtcaattaaagccattgccctggccaccctgcagattatcaatgaccggatctatccatatgctgccatctcctatgaagaatggaatgaccctcctgctgtggtaagtgaattccagtgctagccacatgaggcatggtccagctgtcagggtgggtggaaggaaaaatgtactacaattgtaaaggttatttaaattctagctttctaagatgagagtgtgctttttatacttggggcctgataagggcagcataattttgaaacactga

SEQ ID NO: 437021 - DNA, 1193 bp, Homo sapiens
ctgtctgagcatttcactgcggagcctgagcgcgcctgcctgggaaaacactgcagcggtgctcggactcctcctgtccagcaggaggcgcggcccggcagctcccgcatgcgcagtgcgctcggtgtcagacggcccggatcccggttaccggcccctcgctcgctgctcgccagcccagactcggccctggcagtggcggctggcgattcggaccgatccgacctgggcggaggtggcccgcgccccgcggcatgagccggtgaccaagctcggggccgagcgggaggcagccgtggccgaggagtgtgaggaagaggctgtctgtgtcattatgtgtgcgtcggtcaagtataatatccggggtcctgccctcatcccaagaatgaagaccaagcaccgaatctactatatcaccctcttctccattgtcctcctgggcctcattgccactggcatgtttcagttttggccccattctatcgagtcctcaaatgactggaatgtagagaagcgcagcatccgtgatgtgccggttgttaggctgccagccgacagtcccatcccagagcggggggatctcagttgcagaatgcacacgtgttttgatgtctatcgctgtggcttcaacccaaagaacaaaatcaaggtgtatatctatgctctgaaaaagtacgtggatgactttggcgtctctgtcagcaacaccatctcccgggagtataatgaactgctcatggccatctcagacagtgactactacactgatgacatcaaccgggcctgtctgtttgttccctccatcgatgtgcttaaccagaacacactgcgcatcaaggagacagcacaagcgatggcccagctctctaggtgggatcgaggtacgaatcacctgttgttcaacatgttgcctggaggtcccccagattataacacagccctggatgtccccagagacagggccctgttggctggtggcggcttttctacgtggacttaccggcaaggctacgatgtcagcattcctgtctatagtccactgtcagctgaggtggatcttccagagaaaggaccaggtccacggcaatacttcctcctgtcatctcaggtgggtctccatcctgagtacagagaggacctagaagccctccagcctgagtgacagagtgaaaccctgtctcaaaacaaaacaa

SEQ ID NO: 437022 - DNA, 1976 bp, Homo sapiens
cacgctggcccaatggcacccgctgtgcccaatggcagtctcaagggttcaccgccatagtcctcacctacgaccgagtagagagcctcttccgggtcatcactgaagtgtccaaggtgcccagtctatccaaactacttgtcgtctggaataatcagaataaaaaccctccagaagattctctctggcccaaaatccgggttccattaaaagttgtgaggactgctgaaaacaagttaagtaaccgtttcttcccttatgatgaaatcgagacagaagctgttctggccattgatgatgatatcattatgctgacctctgacgagctgcaatttggttatgaggtctggcgggaatttcctgaccggttggtgggttacccgggtcgtctgcatctctgggaccatgagatgaataagtggaagtatgagtctgagtggacgaatgaagtgtccatggtgctcactggggcagctttttatcacaagtattttaattacctgtatacctacaaaatgcctggggatatcaagaactgggtagatgctcatatgaactgtgaagatattgccatgaacttcctggtggccaacgtcacgggaaaagcagttatcaaggtaaccccacgaaagaaattcaagtgtcctgagtgcacagccatagatgggctttcactagaccaaacacacatggtggagaggtcagagtgcatcaacaagtttgcttcagtcttcgggaccatgcctctcaaggtggtggaacaccgagctgaccctgtcctgtacaaagatgactttcctgagaagctgaagagcttccccaacattggcagcttatgaaacgtgtcattggtggaggtctgaatgtgaggctgggacagagggagagaacaaggcctcccagcactctgatgtcagagtagtaggttaagggtggaaggttgacctacttggatcttggcatgcacccacctaacccactttctcaagaacaagaacctagaatgaatatccaagcacctcgagctatgcaacctctgttcttgtatttcttatgatctctgatgggttcttctcgaaaatgccaagtggaagactttgtggcatgctccagatttaaatccagctgaggctccctttgttttcagttccatgtaacaatctggaaggaaacttcacggacaggaagactgctggagaagagaagcgtgttagcccatttgaggtctggggaatcatgtaaagggtacccagacctcacttttagttatttacatcaatgagttctttcagggaaccaaacccagaattcggtgcaaaagccaaacatcttggtgggatttgataaatgccttgggacctggagtgctgggcttgtgcacaggaagagcaccagccgctgagtcaggatcctgtcagttccatgagctattcctctttggtttggctttttgatatgattaaaattattttttattcctttttatactgtgtcttaaacaccaattcctgatagtccaaggaaccacctttctcccttgatatatttaactccgtctttggcctgacaacagtcttctgcccatgtctgggaacacacgccaggaggaatgtctgataccctctgcatcaagcgtaagaaggtcccaaatcataaccattttaagaacagatgactcagaaacctccagaggaatctgtttgcttcctgattagatccagtcaatgttttaaaggtattgtcagagaaaaacagagggtctgtactagccatgcaaggagtcgctctagctggtacccgtaaaagttgtgggattgtgaccccccatcccaaggggatgccaaaatttctctcattcttttggtataaacttaacattagccagggaggttctggctaacgttaaatgctgctatacaactgctttgcaacagttgctggtatatttaaatcattaaatttcagcatttactaat

SEQ ID NO: 437023 - DNA, 3136 bp, Homo sapiens
ctgtctgagcatttcactgcggagcctgagcgcgcctgcctgggaaaacactgcagcggtgctcggactcctcctgtccagcaggaggcgcggcccggcagctcccgcatgcgcagtgcgctcggtgtcagacggcccggatcccggttaccggcccctcgctcgctgctcgccagcccagactcggccctggcagtggcggctggcgattcggaccgatccgacctgggcggaggtggcccgcgccccgcggcatgagccggtgaccaagctcggggccgagcgggaggcagccgtggccgaggagtgtgaggaagaggctgtctgtgtcattatgtgtgcgtcggtcaagtataatatccggggtcctgccctcatcccaagaatgaagaccaagcaccgaatctactatatcaccctcttctccattgtcctcctgggcctcattgccactggcatgtttcagttttggccccattctatcgagtcctcaaatgactggaatgtagagaagcgcagcatccgtgatgtgccggttgttaggctgccagccgacagtcccatcccagagcggggggatctcagttgcagaatgcacacgtgttttgatgtctatcgctgtggcttcaacccaaagaacaaaatcaaggtgtatatctatgctctgaaaaagtacgtggatgactttggcgtctctgtcagcaacaccatctcccgggagtataatgaactgctcatggccatctcagacagtgactactacactgatgacatcaaccgggcctgtctgtttgttccctccatcgatgtgcttaaccagaacacactgcgcatcaaggagacagcacaagcgatggcccagctctctaggtgggatcgaggtacgaatcacctgttgttcaacatgttgcctggaggtcccccagattataacacagccctggatgtccccagagacagggccctgttggctggtggcggcttttctacgtggacttaccggcaaggctacgatgtcagcattcctgtctatagtccactgtcagctgaggtggatcttccagagaaaggaccaggtccacggcaatacttcctcctgtcatctcaggtgggtctccatcctgagtacagagaggacctagaagccctccaggtcaaacatggagagtcagtgttagtactcgataaatgcaccaacctctcagagggtgtcctttctgtccgtaagcgctgccacaagcaccaggtcttcgattacccacaggtgctacaggaggctactttctgtgtggttcttcgtggagctcggctgggccaggcagtattgagcgatgtgttacaagctggctgtgtcccggttgtcattgcagactcctatattttgcctttctctgaagttcttgactggaagagagcatctgtggttgtaccagaagaaaagatgtcagatgtgtacagtattttgcagagcatcccccaaagacagattgaagaaatgcagagacaggcccggtggttctgggaagcgtacttccagtcaattaaagccattgccctggccaccctgcagattatcaatgaccggatctatccatatgctgccatctcctatgaagaatggaatgaccctcctgctgtgaagtggggcagcgtgagcaatccactcttcctcccgctgatcccaccacagtctcaagggttcaccgccatagtcctcacctacgaccgagtagagagcctcttccgggtcatcactgaagtgtccaaggtgcccagtctatccaaactacttgtcgtctggaataatcagaataaaaaccctccagaagattctctctggcccaaaatccgggttccattaaaagttgtgaggactgctgaaaacaagttaagtaaccgtttcttcccttatgatgaaatcgagacagaagctgttctggccattgatgatgatatcattatgctgacctctgacgagctgcaatttggttatgaggtctggcgggaatttcctgaccggttggtgggttacccgggtcgtctgcatctctgggaccatgagatgaataagtggaagtatgagtctgagtggacgaatgaagtgtccatggtgctcactggggcagctttttatcacaagtattttaattacctgtatacctacaaaatgcctggggatatcaagaactgggtagatgctcatatgaactgtgaagatattgccatgaacttcctggtggccaacgtcacgggaaaagcagttatcaaggtaaccccacgaaagaaattcaagtgtcctgagtgcacagccatagatgggctttcactagaccaaacacacatggtggagaggtcagagtgcatcaacaagtttgcttcagtcttcgggaccatgcctctcaaggtggtggaacaccgagctgaccctgtcctgtacaaagatgactttcctgagaagctgaagagcttccccaacattggcagcttatgaaacgtgtcattggtggaggtctgaatgtgaggctgggacagagggagagaacaaggcctcccagcactctgatgtcagagtagtaggttaagggtggaaggttgacctacttggatcttggcatgcacccacctaacccactttctcaagaacaagaacctagaatgaatatccaagcacctcgagctatgcaacctctgttcttgtatttcttatgatctctgatgggttcttctcgaaaatgccaagtggaagactttgtggcatgctccagatttaaatccagctgaggctccctttgttttcagttccatgtaacaatctggaaggaaacttcacggacaggaagactgctggagaagagaagcgtgttagcccatttgaggtctggggaatcatgtaaagggtacccagacctcacttttagttatttacatcaatgagttctttcagggaaccaaacccagaattcggtgcaaaagccaaacatcttggtgggatttgataaatgccttgggacctggagtgctgggcttgtgcacaggaagagcaccagccgctgagtcaggatcctgtcagttccatgagctattcctctttggtttggctttttgatatgattaaaattattttttattccttttt

SEQ ID NO: 437024 - DNA, 3658 bp, Homo sapiens
  misc_feature (1524)..(1524): n is a, c, g, or t
ctgtctgagcatttcactgcggagcctgagcgcgcctgcctgggaaaacactgcagcggtgctcggactcctcctgtccagcaggaggcgcggcccggcagctcccgcatgcgcagtgcgctcggtgtcagacggcccggatcccggttaccggcccctcgctcgctgctcgccagcccagactcggccctggcagtggcggctggcgattcggaccgatccgacctgggcggaggtggcccgcgccccgcggcatgagccggtgaccaagctcggggccgagcgggaggcagccgtggccgaggagtgtgaggaagaggctgtctgtgtcattatgtgtgcgtcggtcaagtataatatccggggtcctgccctcatcccaagaatgaagaccaagcaccgaatctactatatcaccctcttctccattgtcctcctgggcctcattgccactggcatgtttcagttttggccccattctatcgagtcctcaaatgactggaatgtagagaagcgcagcatccgtgatgtgccggttgttaggctgccagccgacagtcccatcccagagcggggggatctcagttgcagaatgcacacgtgttttgatgtctatcgctgtggcttcaacccaaagaacaaaatcaaggtgtatatctatgctctgaaaaagtacgtggatgactttggcgtctctgtcagcaacaccatctcccgggagtataatgaactgctcatggccatctcagacagtgactactacactgatgacatcaaccgggcctgtctgtttgttccctccatcgatgtgcttaaccagaacacactgcgcatcaaggagacagcacaagcgatggcccagctctctaggtgggatcgaggtacgaatcacctgttgttcaacatgttgcctggaggtcccccagattataacacagccctggatgtccccagagacagggccctgttggctggtggcggcttttctacgtggacttaccggcaaggctacgatgtcagcattcctgtctatagtccactgtcagctgaggtggatcttccagagaaaggaccaggtccacggcaatacttcctcctgtcatctcaggtgggtctccatcctgagtacagagaggacctagaagccctccaggtcaaacatggagagtcagtgttagtactcgataaatgcaccaacctctcagagggtgtcctttctgtccgtaagcgctgccacaagcaccaggtcttcgattacccacaggtgctacaggaggctactttctgtgtggttcttcgtggagctcggctgggccaggcagtattgagcgatgtgttacaagctggctgtgtcccggttgtcattgcagactcctatattttgcctttctctgaagttcttgactggaagagagcatctgtggttgtaccagaagaaaagatgtcagatgtgtacagtattttgcagagcatcccccaaagacagattgaagaaatgcagagacagctcttcatggaaccagncaggagagagaactggtcagctgctaatcaccaaatgaactccctgatctggcctagggaacagtgggattcacagattatcaatgaccggatctatccatatgctgccatctcctatgaagaatggaatgaccctcctgctgtgaagtggggcagcgtgagcaatccactcttcctcccgctgatcccaccacagtctcaagggttcaccgccatagtcctcacctacgaccgagtagagagcctcttccgggtcatcactgaagtgtccaaggtgcccagtctatccaaactacttgtcgtctggaataatcagaataaaaaccctccagaagattctctctggcccaaaatccgggttccattaaaagttgtgaggactgctgaaaacaagttaagtaaccgtttcttcccttatgatgaaatcgagacagaagctgttctggccattgatgatgatatcattatgctgacctctgacgagctgcaatttggttatgaggtctggcgggaatttcctgaccggttggtgggttacccgggtcgtctgcatctctgggaccatgagatgaataagtggaagtatgagtctgagtggacgaatgaagtgtccatggtgctcactggggcagctttttatcacaagtattttaattacctgtatacctacaaaatgcctggggatatcaagaactgggtagatgctcatatgaactgtgaagatattgccatgaacttcctggtggccaacgtcacgggaaaagcagttatcaaggtaaccccacgaaagaaattcaagtgtcctgagtgcacagccatagatgggctttcactagaccaaacacacatggtggagaggtcagagtgcatcaacaagtttgcttcagtcttcgggaccatgcctctcaaggtggtggaacaccgagctgaccctgtcctgtacaaagatgactttcctgagaagctgaagagcttccccaacattggcagcttatgaaacgtgtcattggtggaggtctgaatgtgaggctgggacagagggagagaacaaggcctcccagcactctgatgtcagagtagtaggttaagggtggaaggttgacctacttggatcttggcatgcacccacctaacccactttctcaagaacaagaacctagaatgaatatccaagcacctcgagctatgcaacctctgttcttgtatttcttatgatctctgatgggttcttctcgaaaatgccaagtggaagactttgtggcatgctccagatttaaatccagctgaggctccctttgttttcagttccatgtaacaatctggaaggaaacttcacggacaggaagactgctggagaagagaagcgtgttagcccatttgaggtctggggaatcatgtaaagggtacccagacctcacttttagttatttacatcaatgagttctttcagggaaccaaacccagaattcggtgcaaaagccaaacatcttggtgggatttgataaatgccttgggacctggagtgctgggcttgtgcacaggaagagcaccagccgctgagtcaggatcctgtcagttccatgagctattcctctttggtttggctttttgatatgattaaaattattttttattcctttttatactgtgtcttaaacaccaattcctgatagtccaaggaaccacctttctcccttgatatatttaactccgtctttggcctgacaacagtcttctgcccatgtctgggaacacacgccaggaggaatgtctgataccctctgcatcaagcgtaagaaggtcccaaatcataaccattttaagaacagatgactcagaaacctccagaggaatctgtttgcttcctgattagatccagtcaatgttttaaaggtattgtcagagaaaaacagagggtctgtactagccatgcaaggagtcgctctagctggtacccgtaaaagttgtgggattgtgaccccccatcccaaggggatgccaaaatttctctcattcttttggtataaacttaacattagccagggaggttctggctaacgttaaatgctgctatacaactgctttgcaacagttgctggtatatttaaatcattaaatttcagcatttactaat

SEQ ID NO: 437025 - DNA, 3725 bp, Homo sapiens
ctgtctgagcatttcactgcggagcctgagcgcgcctgcctgggaaaacactgcagcggtgctcggactcctcctgtccagcaggaggcgcggcccggcagctcccgcatgcgcagtgcgctcggtgtcagacggcccggatcccggttaccggcccctcgctcgctgctcgccagcccagactcggccctggcagtggcggctggcgattcggaccgatccgacctgggcggaggtggcccgcgccccgcggcatgagccggtgaccaagctcggggccgagcgggaggcagccgtggccgagccacagggatctgattcctcccagggggatgtcctgcgcctcagggtccggtggtggcctgcggcatcccttgcggtgccagaagccgtgggacgaggagtgtgaggaagaggctgtctgtgtcattatgtgtgcgtcggtcaagtataatatccggggtcctgccctcatcccaagaatgaagaccaagcaccgaatctactatatcaccctcttctccattgtcctcctgggcctcattgccactggcatgtttcagttttggccccattctatcgagtcctcaaatgactggaatgtagagaagcgcagcatccgtgatgtgccggttgttaggctgccagccgacagtcccatcccagagcggggggatctcagttgcagaatgcacacgtgttttgatgtctatcgctgtggcttcaacccaaagaacaaaatcaaggtgtatatctatgctctgaaaaagtacgtggatgactttggcgtctctgtcagcaacaccatctcccgggagtataatgaactgctcatggccatctcagacagtgactactacactgatgacatcaaccgggcctgtctgtttgttccctccatcgatgtgcttaaccagaacacactgcgcatcaaggagacagcacaagcgatggcccagctctctaggtgggatcgaggtacgaatcacctgttgttcaacatgttgcctggaggtcccccagattataacacagccctggatgtccccagagacagggccctgttggctggtggcggcttttctacgtggacttaccggcaaggctacgatgtcagcattcctgtctatagtccactgtcagctgaggtggatcttccagagaaaggaccaggtccacggcaatacttcctcctgtcatctcaggtgggtctccatcctgagtacagagaggacctagaagccctccaggtcaaacatggagagtcagtgttagtactcgataaatgcaccaacctctcagagggtgtcctttctgtccgtaagcgctgccacaagcaccaggtcttcgattacccacaggtgctacaggaggctactttctgtgtggttcttcgtggagctcggctgggccaggcagtattgagcgatgtgttacaagctggctgtgtcccggttgtcattgcagactcctatattttgcctttctctgaagttcttgactggaagagagcatctgtggttgtaccagaagaaaagatgtcagatgtgtacagtattttgcagagcatcccccaaagacagattgaagaaatgcagagacaggcccggtggttctgggaagcgtacttccagtcaattaaagccattgccctggccaccctgcagattatcaatgaccggatctatccatatgctgccatctcctatgaagaatggaatgaccctcctgctgtgaagtggggcagcgtgagcaatccactcttcctcccgctgatcccaccacagtctcaagggttcaccgccatagtcctcacctacgaccgagtagagagcctcttccgggtcatcactgaagtgtccaaggtgcccagtctatccaaactacttgtcgtctggaataatcagaataaaaaccctccagaagattctctctggcccaaaatccgggttccattaaaagttgtgaggactgctgaaaacaagttaagtaaccgtttcttcccttatgatgaaatcgagacagaagctgttctggccattgatgatgatatcattatgctgacctctgacgagctgcaatttggttatgaggtctggcgggaatttcctgaccggttggtgggttacccgggtcgtctgcatctctgggaccatgagatgaataagtggaagtatgagtctgagtggacgaatgaagtgtccatggtgctcactggggcagctttttatcacaagtattttaattacctgtatacctacaaaatgcctggggatatcaagaactgggtagatgctcatatgaactgtgaagatattgccatgaacttcctggtggccaacgtcacgggaaaagcagttatcaaggtaaccccacgaaagaaattcaagtgtcctgagtgcacagccatagatgggctttcactagaccaaacacacatggtggagaggtcagagtgcatcaacaagtttgcttcagtcttcgggaccatgcctctcaaggtggtggaacaccgagctgaccctgtcctgtacaaagatgactttcctgagaagctgaagagcttccccaacattggcagcttatgaaacgtgtcattggtggaggtctgaatgtgaggctgggacagagggagagaacaaggcctcccagcactctgatgtcagagtagtaggttaagggtggaaggttgacctacttggatcttggcatgcacccacctaacccactttctcaagaacaagaacctagaatgaatatccaagcacctcgagctatgcaacctctgttcttgtatttcttatgatctctgatgggttcttctcgaaaatgccaagtggaagactttgtggcatgctccagatttaaatccagctgaggctccctttgttttcagttccatgtaacaatctggaaggaaacttcacggacaggaagactgctggagaagagaagcgtgttagcccatttgaggtctggggaatcatgtaaagggtacccagacctcacttttagttatttacatcaatgagttctttcagggaaccaaacccagaattcggtgcaaaagccaaacatcttggtgggatttgataaatgccttgggacctggagtgctgggcttgtgcacaggaagagcaccagccgctgagtcaggatcctgtcagttccatgagctattcctctttggtttggctttttgatatgattaaaattattttttattcctttttatactgtgtcttaaacaccaattcctgatagtccaaggaaccacctttctcccttgatatatttaactccgtctttggcctgacaacagtcttctgcccatgtctgggaacacacgccaggaggaatgtctgataccctctgcatcaagcgtaagaaggtcccaaatcataaccattttaagaacagatgactcagaaacctccagaggaatctgtttgcttcctgattagatccagtcaatgttttaaaggtattgtcagagaaaaacagagggtctgtactagccatgcaaggagtcgctctagctggtacccgtaaaagttgtgggattgtgaccccccatcccaaggggatgccaaaatttctctcattcttttggtataaacttaacattagccagggaggttctggctaacgttaaatgctgctatacaactgctttgcaacagttgctggtatatttaaatcattaaatttcagcatttactaat

SEQ ID NO: 437026 - DNA, 2139 bp, Homo sapiens
ctgtctgagcatttcactgcggagcctgagcgcgcctgcctgggaaaacactgcagcggtgctcggactcctcctgtccagcaggaggcgcggcccggcagctcccgcatgcgcagtgcgctcggtgtcagacggcccggatcccggttaccggcccctcgctcgctgctcgccagcccagactcggccctggcagtggcggctggcgattcggaccgatccgacctgggcggaggtggcccgcgccccgcggcatgagccggtgaccaagctcggggccgagcgggaggcagccgtggccgaggagtgtgaggaagaggctgtctgtgtcattatgtgtgcgtcggtcaagtataatatccggggtcctgccctcatcccaagaatgaagaccaagcaccgaatctactatatcaccctcttctccattgtcctcctgggcctcattgccactggcatgtttcagttttggccccattctatcgagtcctcaaatgactggaatgtagagaagcgcagcatccgtgatgtgccggttgttaggctgccagccgacagtcccatcccagagcggggggatctcagttgcagaatgcacacgtgttttgatgtctatcgctgtggcttcaacccaaagaacaaaatcaaggtgtatatctatgctctgaaaaagtacgtggatgactttggcgtctctgtcagcaacaccatctcccgggagtataatgaactgctcatggccatctcagacagtgactactacactgatgacatcaaccgggcctgtctgtttgttccctccatcgatgtgcttaaccagaacacactgcgcatcaaggagacagcacaagcgatggcccagctctctaggtgggatcgaggtacgaatcacctgttgttcaacatgttgcctggaggtcccccagattataacacagccctggatgtccccagagacagggccctgttggctggtggcggcttttctacgtggacttaccggcaaggctacgatgtcagcattcctgtctatagtccactgtcagctgaggtggatcttccagagaaaggaccaggtccacggcaatacttcctcctgtcatctcaggtgggtctccatcctgagtacagagaggacctagaagccctccaggtcaaacatggagagtcagtgttagtactcgataaatgcaccaacctctcagagggtgtcctttctgtccgtaagcgctgccacaagcaccaggtcttcgattacccacaggtgctacaggaggctactttctgtgtggttcttcgtggagctcggctgggccaggcagtattgagcgatgtgttacaagctggctgtgtcccggttgtcattgcagactcctatattttgcctttctctgaagttcttgactggaagagagcatctgtggttgtaccagaagaaaagatgtcagatgtgtacagtattttgcagagcatcccccaaagacagattgaagaaatgcagagacaggcccggtggttctgggaagcgtacttccagtcaattaaagccattgccctggccaccctgcagattatcaatgaccggatctatccatatgctgccatctcctatgaagaatggaatgaccctcctgctgtgaagtggggcagcgtgagcaatccactcttcctcccgctgatcccaccacagtctcaagggttcaccgccatagtcctcacctacgaccgagtagagagcctcttccgggtcatcactgaagtgtccaaggtgcccagtctatccaaactacttgtcgtctggaataatcagaataaaaaccctccagaagattctctctggcccaaaatccgggttccattaaaagttgtgaggactgctgaaaacaagttaagtaaccgtttcttcccttatgatgaaatcgagacagaagctgttctggccattgatgatgatatcattatgctgacctctgacgagctgcaatttggttatgaggtctggcgggaatttcctgaccggttggtgggttacccgggtcgtctgcatctctgggaccatgagatgaataagtggaagtatgagtctgagtggacgaatgaagtgtccatgtgcgcgtaagggcagcaggtaccgaccta

SEQ ID NO: 437027 - DNA, 2673 bp, Homo sapiens
  misc_feature (11)..(11): n is a, c, g, or t
acagctccagntacaacagctccagtacaacagctgtggacttaccggcaaggctacgatgtcagcattcctgtctatagtccactgtcagctgaggtggatcttccagagaaaggaccaggtccacggcaatacttcctcctgtcatctcaggtgggtctccatcctgagtacagagaggacctagaagccctccaggtcaaacatggagagtcagtgttagtactcgataaatgcaccaacctctcagagggtgtcctttctgtccgtaagcgctgccacaagcaccaggtcttcgattacccacaggtgctacaggaggctactttctgtgtggttcttcgtggagctcggctgggccaggcagtattgagcgatgtgttacaagctggctgtgtcccggttgtcattgcagactcctatattttgcctttctctgaagttcttgactggaagagagcatctgtggttgtaccagaagaaaagatgtcagatgtgtacagtattttgcagagcatcccccaaagacagattgaagaaatgcagagacaggcccggtggttctgggaagcgtacttccagtcaattaaagccattgccctggccaccctgcagattatcaatgaccggatctatccatatgctgccatctcctatgaagaatggaatgaccctcctgctgtgaagtggggcagcgtgagcaatccactcttcctcccgctgatcccaccacagtctcaagggttcaccgccatagtcctcacctacgaccgagtagagagcctcttccgggtcatcactgaagtgtccaaggtgcccagtctatccaaactacttgtcgtctggaataatcagaataaaaaccctccagaagattctctctggcccaaaatccgggttccattaaaagttgtgaggactgctgaaaacaagttaagtaaccgtttcttcccttatgatgaaatcgagacagaagctgttctggccattgatgatgatatcattatgctgacctctgacgagctgcaatttggttatgaggtctggcgggaatttcctgaccggttggtgggttacccgggtcgtctgcatctctgggaccatgagatgaataagtggaagtatgagtctgagtggacgaatgaagtgtccatggtgctcactggggcagctttttatcacaagtattttaattacctgtatacctacaaaatgcctggggatatcaagaactgggtagatgctcatatgaactgtgaagatattgccatgaacttcctggtggccaacgtcacgggaaaagcagttatcaaggtaaccccacgaaagaaattcaagtgtcctgagtgcacagccatagatgggctttcactagaccaaacacacatggtggagaggtcagagtgcatcaacaagtttgcttcagtcttcgggaccatgcctctcaaggtggtggaacaccgagctgaccctgtcctgtacaaagatgactttcctgagaagctgaagagcttccccaacattggcagcttatgaaacgtgtcattggtggaggtctgaatgtgaggctgggacagagggagagaacaaggcctcccagcactctgatgtcagagtagtaggttaagggtggaaggttgacctacttggatcttggcatgcacccacctaacccactttctcaagaacaagaacctagaatgaatatccaagcacctcgagctatgcaacctctgttcttgtatttcttatgatctctgatgggttcttctcgaaaatgccaagtggaagactttgtggcatgctccagatttaaatccagctgaggctccctttgttttcagttccatgtaacaatctggaaggaaacttcacggacaggaagactgctggagaagagaagcgtgttagcccatttgaggtctggggaatcatgtaaagggtacccagacctcacttttagttatttacatcaatgagttctttcagggaaccaaacccagaattcggtgcaaaagccaaacatcttggtgggatttgataaatgccttgggacctggagtgctgggcttgtgcacaggaagagcaccagccgctgagtcaggatcctgtcagttccatgagctattcctctttggtttggctttttgatatgattaaaattattttttattcctttttatactgtgtcttaaacaccaattcctgatagtccaaggaaccacctttctcccttgatatatttaactccgtctttggcctgacaacagtcttctgcccatgtctgggaacacacgccaggaggaatgtctgataccctctgcatcaagcgtaagaaggtcccaaatcataaccattttaagaacagatgactcagaaacctccagaggaatctgtttgcttcctgattagatccagtcaatgttttaaaggtattgtcagagaaaaacagagggtctgtactagccatgcaaggagtcgctctagctggtacccgtaaaagttgtgggattgtgaccccccatcccaaggggatgccaaaatttctctcattcttttggtataaacttaacattagccagggaggttctggctaacgttaaatgctgctatacaactgctttgcaacagttgctggtatatttaaatcattaaatttcagcatttactaat

SEQ ID NO: 437028 - DNA, 2436 bp, Homo sapiens
gactaggctaggtacgaggccgtgttaatcggccgacgctgccacaagcaccaggtcttcgattacccacaggtgctacaggaggctactttctgtgtggttcttcgtggagctcggctgggccaggcagtattgagcgatgtgttacaagctggctgtgtcccggttgtcattgcagactcctatattttgcctttctctgaagttcttgactggaagagagcatctgtggttgtaccagaagaaaagatgtcagatgtgtacagtattttgcagagcatcccccaaagacagattgaagaaatgcagagacaggcccggtggttctgggaagcgtacttccagtcaattaaagccattgccctggccaccctgcagattatcaatgaccggatctatccatatgctgccatctcctatgaagaatggaatgaccctcctgctgtgaagtggggcagcgtgagcaatccactcttcctcccgctgatcccaccacagtctcaagggttcaccgccatagtcctcacctacgaccgagtagagagcctcttccgggtcatcactgaagtgtccaaggtgcccagtctatccaaactacttgtcgtctggaataatcagaataaaaaccctccagaagattctctctggcccaaaatccgggttccattaaaagttgtgaggactgctgaaaacaagttaagtaaccgtttcttcccttatgatgaaatcgagacagaagctgttctggccattgatgatgatatcattatgctgacctctgacgagctgcaatttggttatgaggtctggcgggaatttcctgaccggttggtgggttacccgggtcgtctgcatctctgggaccatgagatgaataagtggaagtatgagtctgagtggacgaatgaagtgtccatggtgctcactggggcagctttttatcacaagtattttaattacctgtatacctacaaaatgcctggggatatcaagaactgggtagatgctcatatgaactgtgaagatattgccatgaacttcctggtggccaacgtcacgggaaaagcagttatcaaggtaaccccacgaaagaaattcaagtgtcctgagtgcacagccatagatgggctttcactagaccaaacacacatggtggagaggtcagagtgcatcaacaagtttgcttcagtcttcgggaccatgcctctcaaggtggtggaacaccgagctgaccctgtcctgtacaaagatgactttcctgagaagctgaagagcttccccaacattggcagcttatgaaacgtgtcattggtggaggtctgaatgtgaggctgggacagagggagagaacaaggcctcccagcactctgatgtcagagtagtaggttaagggtggaaggttgacctacttggatcttggcatgcacccacctaacccactttctcaagaacaagaacctagaatgaatatccaagcacctcgagctatgcaacctctgttcttgtatttcttatgatctctgatgggttcttctcgaaaatgccaagtggaagactttgtggcatgctccagatttaaatccagctgaggctccctttgttttcagttccatgtaacaatctggaaggaaacttcacggacaggaagactgctggagaagagaagcgtgttagcccatttgaggtctggggaatcatgtaaagggtacccagacctcacttttagttatttacatcaatgagttctttcagggaaccaaacccagaattcggtgcaaaagccaaacatcttggtgggatttgataaatgccttgggacctggagtgctgggcttgtgcacaggaagagcaccagccgctgagtcaggatcctgtcagttccatgagctattcctctttggtttggctttttgatatgattaaaattattttttattcctttttatactgtgtcttaaacaccaattcctgatagtccaaggaaccacctttctcccttgatatatttaactccgtctttggcctgacaacagtcttctgcccatgtctgggaacacacgccaggaggaatgtctgataccctctgcatcaagcgtaagaaggtcccaaatcataaccattttaagaacagatgactcagaaacctccagaggaatctgtttgcttcctgattagatccagtcaatgttttaaaggtattgtcagagaaaaacagagggtctgtactagccatgcaaggagtcgctctagctggtacccgtaaaagttgtgggattgtgaccccccatcccaaggggatgccaaaatttctctcattcttttggtataaacttaacattagccagggaggttctggctaacgttaaatgctgctatacaactgctttgcaacagttgctggtatatttaaatcattaaatttcagcatttactaat

SEQ ID NO: 437029 - DNA, 2633 bp, Homo sapiens
ttgtcgaccaagccagtagtaatagttattgttacttgctctgttcagcacaactgtagttcacttgaacttcactgtcattccctacgctcctctcttactgagaagcatgggtgggattcagggctgtgggacaagctacagcctactctggagcactcacccccatgactcagtccagcctgtctcttgggaagtttattgcaatgtgcagacggatgaatttctgcttttcatgccacctctctgaggtatgtattctatcttgagtatgtacaagatgataccttttggctgggcacagtggctcgtgcctgtaatcccagcactttgggagaccaagatgggcggatcacttgaggtcaggagtttgagaccagcctggccaacatggtgaaaccccgtctctactaaaaatataaaaattagccgggcgtagtacatgcctgtaatcccagctactcccgaggctgaggcagaattgcttgaacccaggaggcggaggttgcagtgagctgagatcgcgccgctgcactccagcctaagtgacagagtgagacacgttaagaagaaaaaaaaaaaaaaggataccttcatttctgactcaatatcctagatccaaaggacaggaaattagggaaggcttcaccctggtgggatcaagataagaagatcccatacttcttcccaggtaaggaggcctgtggcaggtcatgattcaaagctgacttggaatggcagaaactgctgagaggccacccttgcagatttgtgccttcaaagatgggtttcatgagtctcagagaggaaaagactggtcagctgggttgattttgcatgattattgaactagagctggtagacacgagcttctcagatggcagtggccagatcctccatctgtgagaatccgccacttgaagtggtttcctgagagtgttcacttggcagttgctgcgtttctcaagcccacctggcgaggtctcgccggacccttccctccaagtgcacttacttcttcatccccatgtacatctctaactttgaaattgtttacctctcctacaaaaatcttaccttttgacctgagcagagtagcaaagccctgttcactctgagggagcagctggcgtgttgaaggggaaaggccaggcacagcactgtcctcagaccacaccatatttggagcagaattgtgatacatgtcatctgtgtctattctggaaggttctttgttcatcactgtactcgcatcagcaaattttcagggtcctacctgtcactccaggctactgagctgaaccctcagaagctgaggtctccgagcatgctaagtaaccttttagaaaagctggaggcaaactgtcgaatgctagcaggctttatgaaaggaaacataaggagtttgtgtagtcagaacttgcttaaatttgcttcggaattaggcaccataaactttagttggagaatgggacttaaattttcacatatatgtatacttaattttcagcaattatgacacaataaaaagaatatgcaaatttattgttgtttcagaaggttttgcaggactgggaacgctttagtgtcatcaacagtaaacctcagatactgttctgcacagttcagaagtaccataccaggtattgtgagtggcaagaacgccaggggacagagatgcttctggtagatgagggccagagaaaccagctctcctccattttgacagcaatttctcactgtggccatttggcctccattatgttttgagaggaatttcttgagatcttgagaaatcaccatgattaggccaattgtcaatcagtattcagaaactagaaaggaacaatgagatacttgtttatggttctttagggcatatgtttgaaaaccctctcatctcagatctgtatagctggtgtgtgtttgtgtccataaatacacgtgcattgctgtcgtgcccattaagaaagggggagtaagtaaaagaggaatcgctcagatctttccttggatgaacagcagtggcgtggttggtgtgttgactgtgaacaggctgacttagctgttgatgtatactcagaacctccatctcctcccagaccctgcacttttccttctctgcagtctgattctctaatgactgtcactggacaaaccccagttttatgctcgcttagtaaaaataagtttaaacatttcatggtggttgacagaactttgtccccaaacatgcggattcaattccttaaaactcgttgaacgtttataccaaaggtcccgccccgcaggtgtgtatgtggtgcacagagggtgaggtttggagcatcgggcactgtgtgcattgctaaggggacatagtgagacaatgtgggatttaactaaaaacacatcaattgtgtgtcacattaccagtgttgtcaggtatttgttcttaattgttattgtaatatattttcagttgtttttctaatttaattctctccgtctgttgtctgactgtgaactgctaacagtgttaaacttgatgtaaataaatgaggcccttgaaagggactgctttctctgtcttctcacaaggtttgccaagttgtgttctgttttaaataaaggttgcaatattttattggcaa

SEQ ID NO: 437030 - DNA, 2950 bp, Homo sapiens
  misc_feature (2950)..(2950): n is a, c, g, or t
ttgtcgaccaagccagtagtaatagttattgttacttgctctgttcagcacaactgtagttcacttgaacttcactgtcattccctacgctcctctcttactgagaagcatgggtgggattcagggctgtgggacaagctacagcctactctggagcactcacccccatgactcagtccagcctgtctcttgggaagtttattgcaatgtgcagacggatgaatttctgcttttcatgccacctctctgaggtatgtattctatcttgagtatgtacaagatgataccttttggctgggcacagtggctcgtgcctgtaatcccagcactttgggagaccaagatgggcggatcacttgaggtcaggagtttgagaccagcctggccaacatggtgaaaccccgtctctactaaaaatataaaaattagccgggcgtagtacatgcctgtaatcccagctactcccgaggctgaggcagaattgcttgaacccaggaggcggaggttgcagtgagctgagatcgcgccgctgcactccagcctaagtgacagagtgagacacgttaagaagaaaaaaaaaaaaaaggataccttcatttctgactcaatatcctagatccaaaggacaggaaattagggaaggcttcaccctggtgggatcaagataagaagatcccatacttcttcccaggtaaggaggcctgtggcaggtcatgattcaaagctgacttggaatggcagaaactgctgagaggccacccttgcagatttgtgccttcaaagatgggtttcatgagtctcagagaggaaaagactggtcagctgggttgattttgcatgattattgaactagagctggtagacacgagcttctcagatggcagtggccagatcctccatctgtgagaatccgccacttgaagtggtttcctgagagtgttcacttggcagttgctgcgtttctcaagcccacctggcgaggtctcgccggacccttccctccaagtgcacttacttcttcatccccatgtacatctctaactttgaaattgtttacctctcctacaaaaatcttaccttttgacctgagcagagtagcaaagccctgttcactctgagggagcagctggcgtgttgaaggggaaaggccaggcacagcactgtcctcagaccacaccatatttggagcagaattgtgatacatgtcatctgtgtctattctggaaggttctttgttcatcactgtactcgcatcagcaaattttcagggtcctacctgtcactccaggctactgagctgaaccctcagaagctgaggtctccgagcatgctaagtaaccttttagaaaagctggaggcaaactgtcgaatgctagcaggctttatgaaaggaaacataaggagtttgtgtagtcagaacttgcttaaatttgcttcggaattaggcaccataaactttagttggagaatgggacttaaattttcacatatatgtatacttaattttcagcaattatgacacaataaaaagaatatgcaaatttattgttgtttcagaaggttttgcaggactgggaacgctttagtgtcatcaacagtaaacctcagatactgttctgcacagttcagaagtaccataccaggtattgtgagtggcaagaacgccaggggacagagatgcttctggtagatgagggccagagaaaccagctctcctccattttgacagcaatttctcactgtggccatttggcctccattatgttttgagaggaatttcttgagatcttgagaaatcaccatgattaggccaattgtcaatcagtattcagaaactagaaaggaacaatgagatacttgtttatggttctttagggcatatgtttgaaaaccctctcatctcagatctgtatagctggtgtgtgtttgtgtccataaatacacgtgcattgctgtcgtgcccattaagaaagggggagtaagtaaaagaggaatcgctcagatctttccttggatgaacagcagtggcgtggttggtgtgttgactgtgaacaggctgacttagctgttgatgtatactcagaacctccatctcctcccagaccctgcacttttccttctctgcagtctgattctctaatgactgtcactggacaaaccccagttttatgctcgcttagtaaaaataagtttaaacatttcatggtggttgacagaactttgtccccaaacatgcggattcaattccttaaaactcgttgaacgtttataccaaaggtcccgccccgcaggtgtgtatgtggtgcacagagggtgaggtttggagcatcgggcactgtgtgcattgctaaggggacatagtgagacaatgtgggatttaactaaaaacacatcaattgtgtgtcacattaccagtgttgtcaggtatttgttcttaattgttattgtaatatattttcagttgtttttctaatttaattctctccgtctgttgtctgactgtgaactgctaacagtgttaaacttgatgtaaataaatgaggcccttgaaagggaaaaaaaaaaaaacaaaaaaaaaaaaaaaaaaaaaaaaagggggggggggggaaaaaaatctccgggggggcaaagttattggtatcccatttttgtgagcagggagggcccataaggggggcaggaataaaagaagcgccgggcgcgggtaacaaagggcgtgttgcggaaactggtcggtgacactgcggacagcccactggtctgggcactgtgggaccacccccaggaggtttaggcccggacaaaacactagggctagtggacccagcgctgcgtcgtgaattggctgctttttaaattacggacaacatgggggcagactagacgcacgacgaagctagacgatgagacacgacgcagcacaaaacaagcagcagacagtaaagacgan

SEQ ID NO: 437031 - DNA, 1530 bp, Homo sapiens
ttgtcgaccaagccagtagtaatagttattgttacttgctctgttcagcacaactgtagttcacttgaacttcactgtcattccctacgctcctctcttactgagaagcatgggtgggattcagggctgtgggacaagctacagcctactctggagcactcacccccatgactcagtccagcctgtctcttgggaagtttattgcaatgtgcagacggatgaatttctgcttttcatgccacctctctgaggtatgtattctatcttgagtatgtacaagatgataccttttggctgggcacagtggctcgtgcctgtaatcccagcactttgggagaccaagatgggcggatcacttgaggtcaggagtttgagaccagcctggccaacatggtgaaaccccgtctctactaaaaatataaaaattagccgggcgtagtacatgcctgtaatcccagctactcccgaggctgaggcagaattgcttgaacccaggaggcggaggttgcagtgagctgagatcgcgccgctgcactccagcctaagtgacagagtgagacacgttaagaagaaaaaaaaaaaaaaggataccttcatttctgactcaatatcctagatccaaaggacaggaaattagggaaggcttcaccctggtgggatcaagataagaagatcccatacttcttcccaggtaaggaggcctgtggcaggtcatgattcaaagctgacttggaatggcagaaactgctgagaggccacccttgcagatttgtgccttcaaagatgggtttcatgagtctcagagaggaaaagactggtcagctgggttgattttgcatgattattgaactagagctggtagacacgagcttctcagatggcagtggccagatcctccatctgtgagaatccgccacttgaagtggtttcctgagagtgttcacttggcagttgctgcgtttctcaagcccacctggcgaggtctcgccggacccttccctccaagtgcacttacttcttcatccccatgtacatctctaactttgaaattgtttacctctcctacaaaaatcttaccttttgacctgagcagagtagcaaagccctgttcactctgagggagcagctggcgtgttgaaggggaaaggccaggcacagcactgtcctcagaccacaccatatttggagcagaattgtgatacatgtcatctgtgtctattctggaaggttctttgttcatcactgtactcgcatcagcaaattttcagggtcctacctgtcactccaggctactgagctgaaccctcagaagctgaggtctccgagcatgctaagtaaccttttagaaaagctggaggcaaactgtcgaatgctagcaggctttatgaaaggaaacataaggagtttgtgtagtcagaacttgcttaaatttgcttcggaattaggcaccataaactttagtttaacttccaaaattcaccagtactgccgagaaatgcgggtcctgaggttccagagaagtggggagtg

SEQ ID NO: 437032 - DNA, 1358 bp, Homo sapiens
ttatatgctgtctcagtggaacaatcttttgttggattgaaacagctaatcagctgcagaaactggagggcagcagtggacctgtgcggacgtctcctcacagcccacggccaggctacggcaaagagcgggctgctcaccagccacacgacagattcaccttgcagctctggtttgtcaggctggcactactagtgaagttgggccttttccagaatgctgagatggaatttgaacccttcggaaatcttgatcagccagatctttattacgagtactacccgcacgtgtaaccctgggcgcaggggctccatggtcccctttcggatgcgcatcttgcacgcggagcttcagaagtaccataccaggtattgtgagtggcaagaacgccaggggacagagatgcttctggtagatgagggccagagaaaccagctctcctccattttgacagcaatttctcactgtggccatttggcctccattatgttttgagaggaatttcttgagatcttgagaaatcaccatgattaggccaattgtcaatcagtattcagaaactagaaaggaacaatgagatacttgtttatggttctttagggcatatgtttgaaaaccctctcatctcagatctgtatagctggtgtgtgtttgtgtccataaatacacgtgcattgctgtcgtgcccattaagaaagggggagtaagtaaaagaggaatcgctcagatctttccttggatgaacagcagtggcgtggttggtgtgttgactgtgaacaggctgacttagctgttgatgtatactcagaacctccatctcctcccagaccctgcacttttccttctctgcagtctgattctctaatgactgtcactggacaaaccccagttttatgctcgcttagtaaaaataagtttaaacatttcatggtggttgacagaactttgtccccaaacatgcggattcaattccttaaaactcgttgaacgtttataccaaaggtcccgccccgcaggtgtgtatgtggtgcacagagggtgaggtttggagcatcgggcactgtgtgcattgctaaggggacatagtgagacaatgtgggatttaactaaaaacacatcaattgtgtgtcacattaccagtgttgtcaggtatttgttcttaattgttattgtaatatattttcagttgtttttctaatttaattctctccgtctgttgtctgactgtgaactgctaacagtgttaaacttgatgtaaataaatgaggcccttgaaagggactgctttctctgtcttctcacaaggtttgccaagttgtgttctgttttaaataaaggttgcaatattttattggcaa

SEQ ID NO: 437033 - DNA, 795 bp, Homo sapiens
ctggctcataataataaaagcttctacttacatagcattactttgttccaggcaattttctaagtgtgttatatatattaactcactccatcttcacaaccactctgaatagaagctgttgttatctgtgttttgcaggtggaaaatgaagcacagagaagttcagtgatggacctcagatactaccagcagaaagcagaagagctaggatttcaacttaggatgtctggatccacagtctgcactcctacccactatgctacactgcctctaactatgaggaagcaagggcatttttttttttctggtgactaaaaagataagagttcaagtatgtggctcctgataatctaacttatacagcctggaaaaattgatagttactatatccagactgtctcattcaattaacagtttctcaagtaatcttctagttactgtcgtattttatctgtatcaacttagcaaaccaagtccaaaacattttatatgtgtctatctttcctgctgttcatattattgagttagccaaataaattcaattttttttctactgtttgtttctcacaaattatgactggcatctgtatatctgggaaggttctactgcattgctgtattatcactatataattataacgagatcacagagtgcattgatgaaggccatgttgagacatgatgaaacagggtccattgtgactgggtgaaactgtcttcaatttcctggtctataaagcagaggtgagaacaactgactcatagcattgcggtgaatattagattaaataagat

SEQ ID NO: 437034 - DNA, 591 bp, Homo sapiens
gatcagattgtggaaagcgcacgtaattgtcacgcggcactacgtcgacccgcctttgttagaaggaaggatctcactatgttgccttgcatggactggaactccttggctcaagaaatcttcttgcctcagcctcccaaatagctaggactatatgcacatgctactacacctagtggaaaatgaagcacagagaagttcagtgatggacctcagatactaccagcagaaagcagaagagctaggatttcaacttaggatgtctggatccacagtctgcactcctacccactatgctacactgcctctaactatgaggaagcaagggcatttttttttttctggtgactaaaaagataagagttcaagtatgtggctcctgataatctaacttatacagcctggaaaaattgatagttactatatccagactgtctcattcaattaacagtttctcaagtaatcttctagttactgtcgtattttatctgtatcaacttagcaaaccaagtccaaaacattttatatgtgtctatctttcctgctgttcatattattgagttagccaaataaattcaattttttttctac

SEQ ID NO: 437035 - DNA, 570 bp, Homo sapiens
attcgtagggttgtacccgaaaaaagagggacccttcaggtgcaacaggatctcactatgttgccttgcatggactggaactccttggctcaagaaatcttcttgcctcagcctcccaaatagctaggactatatgcacatgctactacacctagtggaaaatgaagcacagagaagttcagtgatggacctcagatactaccagcagaaagcagaagagctaggatttcaacttaggatgtctggatccacagtctgcactcctacccactatgctacactgcctctaactatgaggaagcaagggcatttttttttttctggtgactaaaaagataagagttcaagtatgtggctcctgataatctaacttatacagcctggaaaaattgatagttactatatccagactgtctcattcaattaacagtttctcaagtaatcttctagttactgtcgtattttatctgtatcaacttagcaaaccaagtccaaaacattttatatgtgtctatctttcctgctgttcatattattgagttagccaaataaattcaattttttttctac

SEQ ID NO: 437036 - DNA, 554 bp, Homo sapiens
ctggctcataataataaaagcttctacttacatagcattactttgttccaggcaattttctaagtgtgttatatatattaactcactccatcttcacaaccactctgaatagaagctgttgttatctgtgttttgcaggtggaaaatgaagcacagagaagttcagtgatggacctcagatactaccagcagaaagcagaagagctaggatttcaacttaggatgtctggatccacagtctgcactcctacccactatgctacactgcctctaactatgaggaagcaagggcatttttttttttctggtgactaaaaagataagagttcaagtatgtggctcctgataatctaacttatacagcctggaaaaattgatagttactatatccagactgtctcattcaattaacagtttctcaagtaatcttctagttactgtcgtattttatctgtatcaacttagcaaaccaagtccaaaacattttatatgtgtctatctttcctgctgttcatattattgagttagccaaataaattcaattttttttctac

SEQ ID NO: 437037 - DNA, 651 bp, Homo sapiens
gatcagattgtggaaagcgcacgtaattgtcacgcggcactacgtcgacccgcctttgttagaaggaaggatctcactatgttgccttgcatggactggaactccttggctcaagaaatcttcttgcctcagcctcccaaatagctaggactatatgcacatgctactacacctagtggaaaatgaagcacagagaagttcagtgatggacctcagatactaccagcagaaagcagaagagctaggatttcaacttaggatgtctggatccacagtctgcactcctacccactatgctacactgcctctaactatgaggaagcaagggcatttttttttttctggtgactaaaaagataagagttcaagtatgtggctcctgataatctaacttatacagcctggaaaaattgatagttactatatccagactgtctcattcaattaacagtttctcaagtaatcttctagttactgtcgtattttatctgtatcaacttagcaaaccaagtccaaaacattttatatgtgtctatctttcctgctgttcatattattgagttagccaaataaattcaattttttttctacaaaaaaacccacccacccccttatatctcaatccggcctctttggcctcaccgggggact

SEQ ID NO: 437038 - DNA, 617 bp, Homo sapiens
tatttagccccacccccctatatcatcacgagacaccgttgcccacccccgtttagttggacacaggatctcactatgttgccttgcatggactggaactccttggctcaagaaatcttcttgcctcagcctcccaaatagctaggactatatgcacatgctactacacctagtggaaaatgaagcacagagaagttcagtgatggacctcagatactaccagcagaaagcagaagagctaggatttcaacttaggatgtctggatccacagtctgcactcctacccactatgctacactgcctctaactatgaggaagcaagggcatttttttttttctggtgactaaaaagataagagttcaagtatgtggctcctgataatctaacttatacagcctggaaaaattgatagttactatatccagactgtctcattcaattaacagtttctcaagtaatcttctagttactgtcgtattttatctgtatcaacttagcaaaccaagtccaaaacattttatatgtgtctatctttcctgctgttcatattattgagttagccaaataaattcaattttttttctacaaaagaaaaaaatgctctcgttggcctca

SEQ ID NO: 437039 - DNA, 476 bp, Homo sapiens
tatcctcccccccccccccgacagtcagcacatgatccaacacccaccccaccactttaggtggaaaatgaagcacagagaagttcagtgatggacctcagatactaccagcagaaagcagaagagctaggatttcaacttaggatgtctggatccacagtctgcactcctacccactatgctacactgcctctaactatgaggaagcaagggcatttttttttttctggtgactaaaaagataagagttcaagtatgtggctcctgataatctaacttatacagcctggaaaaattgatagttactatatccagactgtctcattcaattaacagtttctcaagtaatcttctagttactgtcgtattttatctgtatcaacttagcaaaccaagtccaaaacattttatatgtgtctatctttcctgctgttcatattattgagttagccaaataaattcaattttttttctac

SEQ ID NO: 437040 - DNA, 468 bp, Homo sapiens
  misc_feature (28)..(28): n is a, c, g, or t
tagggaagaagtgataaggtagatggtnaagcgttcaattttccttctctaggtggaaaatgaagcacagagaagttcagtgatggacctcagatactaccagcagaaagcagaagagctaggatttcaacttaggatgtctggatccacagtctgcactcctacccactatgctacactgcctctaactatgaggaagcaagggcatttttttttttctggtgactaaaaagataagagttcaagtatgtggctcctgataatctaacttatacagcctggaaaaattgatagttactatatccagactgtctcattcaattaacagtttctcaagtaatcttctagttactgtcgtattttatctgtatcaacttagcaaaccaagtccaaaacattttatatgtgtctatctttcctgctgttcatattattgagttagccaaataaattcaattttttttctac

SEQ ID NO: 437041 - DNA, 811 bp, Homo sapiens
attcgtagggttgtacccgaaaaaagagggacccttcaggtgcaacaggatctcactatgttgccttgcatggactggaactccttggctcaagaaatcttcttgcctcagcctcccaaatagctaggactatatgcacatgctactacacctagtggaaaatgaagcacagagaagttcagtgatggacctcagatactaccagcagaaagcagaagagctaggatttcaacttaggatgtctggatccacagtctgcactcctacccactatgctacactgcctctaactatgaggaagcaagggcatttttttttttctggtgactaaaaagataagagttcaagtatgtggctcctgataatctaacttatacagcctggaaaaattgatagttactatatccagactgtctcattcaattaacagtttctcaagtaatcttctagttactgtcgtattttatctgtatcaacttagcaaaccaagtccaaaacattttatatgtgtctatctttcctgctgttcatattattgagttagccaaataaattcaattttttttctactgtttgtttctcacaaattatgactggcatctgtatatctgggaaggttctactgcattgctgtattatcactatataattataacgagatcacagagtgcattgatgaaggccatgttgagacatgatgaaacagggtccattgtgactgggtgaaactgtcttcaatttcctggtctataaagcagaggtgagaacaactgactcatagcattgcggtgaatattagattaaataagat

SEQ ID NO: 437042 - DNA, 829 bp, Homo sapiens
tatttagccccacccccctatatcatcacgagacaccgttgcccacccccgtttagttggacacaggatctcactatgttgccttgcatggactggaactccttggctcaagaaatcttcttgcctcagcctcccaaatagctaggactatatgcacatgctactacacctagtggaaaatgaagcacagagaagttcagtgatggacctcagatactaccagcagaaagcagaagagctaggatttcaacttaggatgtctggatccacagtctgcactcctacccactatgctacactgcctctaactatgaggaagcaagggcatttttttttttctggtgactaaaaagataagagttcaagtatgtggctcctgataatctaacttatacagcctggaaaaattgatagttactatatccagactgtctcattcaattaacagtttctcaagtaatcttctagttactgtcgtattttatctgtatcaacttagcaaaccaagtccaaaacattttatatgtgtctatctttcctgctgttcatattattgagttagccaaataaattcaattttttttctactgtttgtttctcacaaattatgactggcatctgtatatctgggaaggttctactgcattgctgtattatcactatataattataacgagatcacagagtgcattgatgaaggccatgttgagacatgatgaaacagggtccattgtgactgggtgaaactgtcttcaatttcctggtctataaagcagaggtgagaacaactgactcatagcattgcggtgaatattagattaaataagat

SEQ ID NO: 437043 - DNA, 832 bp, Homo sapiens
gatcagattgtggaaagcgcacgtaattgtcacgcggcactacgtcgacccgcctttgttagaaggaaggatctcactatgttgccttgcatggactggaactccttggctcaagaaatcttcttgcctcagcctcccaaatagctaggactatatgcacatgctactacacctagtggaaaatgaagcacagagaagttcagtgatggacctcagatactaccagcagaaagcagaagagctaggatttcaacttaggatgtctggatccacagtctgcactcctacccactatgctacactgcctctaactatgaggaagcaagggcatttttttttttctggtgactaaaaagataagagttcaagtatgtggctcctgataatctaacttatacagcctggaaaaattgatagttactatatccagactgtctcattcaattaacagtttctcaagtaatcttctagttactgtcgtattttatctgtatcaacttagcaaaccaagtccaaaacattttatatgtgtctatctttcctgctgttcatattattgagttagccaaataaattcaattttttttctactgtttgtttctcacaaattatgactggcatctgtatatctgggaaggttctactgcattgctgtattatcactatataattataacgagatcacagagtgcattgatgaaggccatgttgagacatgatgaaacagggtccattgtgactgggtgaaactgtcttcaatttcctggtctataaagcagaggtgagaacaactgactcatagcattgcggtgaatattagattaaataagat

SEQ ID NO: 437044 - DNA, 681 bp, Homo sapiens
tggatggaggctccagattctaaggtggaaaatgaagcacagagaagttcagtgatggacctcagatactaccagcagaaagcagaagagctaggatttcaacttaggatgtctggatccacagtctgcactcctacccactatgctacactgcctctaactatgaggaagcaagggcatttttttttttctggtgactaaaaagataagagttcaagtatgtggctcctgataatctaacttatacagcctggaaaaattgatagttactatatccagactgtctcattcaattaacagtttctcaagtaatcttctagttactgtcgtattttatctgtatcaacttagcaaaccaagtccaaaacattttatatgtgtctatctttcctgctgttcatattattgagttagccaaataaattcaattttttttctactgtttgtttctcacaaattatgactggcatctgtatatctgggaaggttctactgcattgctgtattatcactatataattataacgagatcacagagtgcattgatgaaggccatgttgagacatgatgaaacagggtccattgtgactgggtgaaactgtcttcaatttcctggtctataaagcagaggtgagaacaactgactcatagcattgcggtgaatattagattaaataagat

SEQ ID NO: 437045 - DNA, 259 bp, Homo sapiens
cccactggaatcattccaactagcctattctaaacctgcttgcccagcttctcccattccctccagtgggaaccacaataaagactcctgcccacattttcctttgtgccttctgcctcctgacccaccccggtgcttccttctgtggcctccctggtggtggggcacatccccaactctttaacaaactatcttttcagtggtagttgtctcctgaacgttggcctccccgtacctgaataaaaatgaaatccacact

SEQ ID NO: 437046 - DNA, 453 bp, Homo sapiens
gcggccgccgggcgcagcatgactgccgtcggcgtgcaggtagccggcgcctggcggggcgctgacccggggtgctgccccgccgtgggaggttgggggtgggaggacggagggaggggcgtacccaccgcgagcgccggcgtcgggctgggggtgcgagcgccccccgtgcccgccccctgttgcaaacctgggtccggaggaggctgggcggggagcaacctcggggggcctgcctgcctcacatagctgctcccggggcgcggactccggctgcttctgctcgcggccttgcaagcacccgaggctcccaaacttcatttggaaagatttttcttctctttggtgtcaccagtgacttactggtcagtttaccataagggtccccctttgtgagaaatgaggcgcgtctggggtggagggacagaatcgacttgcaaagtgaggcttatg

SEQ ID NO: 437047 - DNA, 1817 bp, Homo sapiens
gtctggaagggaggaagggttccccccaaacggtgggtctggtctgttccgggcttcacaggagaccaagcagagaataagacagtgcggagcaggatggagggctcaggggtcttccctgcagaggttcctgggggcgtggcagggctgtggctgacagggtgcttcctacggttttttccaggcccagaggcctttgggccaaaggcagccccgccggtccttctttgaatccttcatccggaccctcatcatcacgtgtgtggccctggctgtggtcctgtcctcggtctccatttgtgatgggcactggctcctggctgaggaccgcctcttcgggctctggcacttctgcaccaccaccaaccagagtgtgccgatctgcttcagagacctgggccaggcccatgtgcccgggctggccgtgggcatgggcctggtacgcagcgtgggcgccttggccgtggtggccgccatttttggcctggagttcctcatggtgtcccagttgtgcgaggacaaacactcacagtgcaagtgggtcatgggttccatcctcctcctggtgtctttcgtcctctcctccggcgggctcctgggttttgtgatcctcctcaggaaccaagtcacactcatcggcttcaccctaatgttttggtgcgaattcactgcctccttcctcctcttcctgaacgccatcagcggccttcacatcaacagcatcacccatccctgggaatgaccgtggaaattttaggccccctccagggacatcagattccacaagaaaatatggtcaaaatgggacttttccagcatgtggcctctggtggggctgggttggacaagggccttgaaacggctgcctgtttgccgataacttgtgggtggtcagccagaaatggccggggggcctctgcacctggtctgcagggccagaggccaggagggtgcctcagtgccaccaactgcacaggcttagccagatgttgattttagaggaagaaaaaaacattttaaaactccttcttgaattttcttccctggactggaatacagttggaagcacaggggtaactggtacctgagctagctgcacagccaaggatagttcatgcctgtttcattgacacgtgctgggataggggctgcagaatccctggggctcccagggttgttaagaatggatcattcttccagctaagggtccaatcagtgcctattcttccaccagctcaaagggccttcgtatgtatgtccctggcttcagctttggtcatgccaaagaggcagagttcaggattccctcagaatgccctgcacacagtaggtttccaaaccatttgactcggtttgcctccctgcccgttgtttaaaccttacaaaccctggataaccccatcttctagcagctggctgtcccctctgggagctctgcctatcagaaccctaccttaaggtgggtttccttccgagaagagttcttgagcaagctctcccaggagggcccacctgactgctaatacacagccctccccaaggcccgtgtgtgcatgtgtctgtcttttgtgagggttagacagcctcagggcaccatttttaatcccagaacacatttcaaagagcacgtatctagacctgctggactctgcagggggtgagggggaacagcgagagcttgggtaatgattaacacccatgctggggatgcatggaggtgaagggggccaggaaccagtggagatttccatccttgccagcacgtctgtacttctgttcattaaagtgctccctttctagtcctttttctgcccaga

SEQ ID NO: 437048 - DNA, 1727 bp, Homo sapiens
tgaccacacacgaaactggagaaggcagtgggtgcagatgacccgacctgactgttcttctgattttaattccaggcacttccctcttggccaggcccagaggcctttgggccaaaggcagccccgccggtccttctttgaatccttcatccggaccctcatcatcacgtgtgtggccctggctgtggtcctgtcctcggtctccatttgtgatgggcactggctcctggctgaggaccgcctcttcgggctctggcacttctgcaccaccaccaaccagagtgtgccgatctgcttcagagacctgggccaggcccatgtgcccgggctggccgtgggcatgggcctggtacgcagcgtgggcgccttggccgtggtggccgccatttttggcctggagttcctcatggtgtcccagttgtgcgaggacaaacactcacagtgcaagtgggtcatgggttccatcctcctcctggtgtctttcgtcctctcctccggcgggctcctgggttttgtgatcctcctcaggaaccaagtcacactcatcggcttcaccctaatgttttggtgcgaattcactgcctccttcctcctcttcctgaacgccatcagcggccttcacatcaacagcatcacccatccctgggaatgaccgtggaaattttaggccccctccagggacatcagattccacaagaaaatatggtcaaaatgggacttttccagcatgtggcctctggtggggctgggttggacaagggccttgaaacggctgcctgtttgccgataacttgtgggtggtcagccagaaatggccggggggcctctgcacctggtctgcagggccagaggccaggagggtgcctcagtgccaccaactgcacaggcttagccagatgttgattttagaggaagaaaaaaacattttaaaactccttcttgaattttcttccctggactggaatacagttggaagcacaggggtaactggtacctgagctagctgcacagccaaggatagttcatgcctgtttcattgacacgtgctgggataggggctgcagaatccctggggctcccagggttgttaagaatggatcattcttccagctaagggtccaatcagtgcctattcttccaccagctcaaagggccttcgtatgtatgtccctggcttcagctttggtcatgccaaagaggcagagttcaggattccctcagaatgccctgcacacagtaggtttccaaaccatttgactcggtttgcctccctgcccgttgtttaaaccttacaaaccctggataaccccatcttctagcagctggctgtcccctctgggagctctgcctatcagaaccctaccttaaggtgggtttccttccgagaagagttcttgagcaagctctcccaggagggcccacctgactgctaatacacagccctccccaaggcccgtgtgtgcatgtgtctgtcttttgtgagggttagacagcctcagggcaccatttttaatcccagaacacatttcaaagagcacgtatctagacctgctggactctgcagggggtgagggggaacagcgagagcttgggtaatgattaacacccatgctggggatgcatggaggtgaagggggccaggaaccagtggagatttccatccttgccagcacgtctgtacttctgttcattaaagtgctccctttctagtcctttttctgcccaga

SEQ ID NO: 437049 - DNA, 1386 bp, Homo sapiens
cggctcggtaccggctcttcgcgtggctcatcgcgaggctcgtggcgtggcgcctggagttcctcatggtgtcccagttgtgcgaggacaaacactcacagtgcaagtgggtcatgggttccatcctcctcctggtgtctttcgtcctctcctccggcgggctcctgggttttgtgatcctcctcaggaaccaagtcacactcatcggcttcaccctaatgttttggtgcgaattcactgcctccttcctcctcttcctgaacgccatcagcggccttcacatcaacagcatcacccatccctgggaatgaccgtggaaattttaggccccctccagggacatcagattccacaagaaaatatggtcaaaatgggacttttccagcatgtggcctctggtggggctgggttggacaagggccttgaaacggctgcctgtttgccgataacttgtgggtggtcagccagaaatggccggggggcctctgcacctggtctgcagggccagaggccaggagggtgcctcagtgccaccaactgcacaggcttagccagatgttgattttagaggaagaaaaaaacattttaaaactccttcttgaattttcttccctggactggaatacagttggaagcacaggggtaactggtacctgagctagctgcacagccaaggatagttcatgcctgtttcattgacacgtgctgggataggggctgcagaatccctggggctcccagggttgttaagaatggatcattcttccagctaagggtccaatcagtgcctattcttccaccagctcaaagggccttcgtatgtatgtccctggcttcagctttggtcatgccaaagaggcagagttcaggattccctcagaatgccctgcacacagtaggtttccaaaccatttgactcggtttgcctccctgcccgttgtttaaaccttacaaaccctggataaccccatcttctagcagctggctgtcccctctgggagctctgcctatcagaaccctaccttaaggtgggtttccttccgagaagagttcttgagcaagctctcccaggagggcccacctgactgctaatacacagccctccccaaggcccgtgtgtgcatgtgtctgtcttttgtgagggttagacagcctcagggcaccatttttaatcccagaacacatttcaaagagcacgtatctagacctgctggactctgcagggggtgagggggaacagcgagagcttgggtaatgattaacacccatgctggggatgcatggaggtgaagggggccaggaaccagtggagatttccatccttgccagcacgtctgtacttctgttcattaaagtgctccctttctagtcctttttctgcccaga

SEQ ID NO: 437050 - DNA, 1998 bp, Homo sapiens
gcggccgccgggcgcagcatgactgccgtcggcgtgcaggtagccggcgcctggcggggcgctgacccggggtgctgccccgccgtgggaggttgggggtgggaggacggagggaggggcgtacccaccgcgagcgccggcgtcgggctgggggtgcgagcgccccccgtgcccgccccctgttgcaaacctgggtccggaggaggctgggcggggagcaacctcggggggcctgcctgcctcacatagctgctcccggggcgcggactccggctgcttctgctcgcggccttgcaagcacccgaggctcccaaacttcatttggaaagatttttcttctctttggtgtcaccagtgacttactggcccagaggcctttgggccaaaggcagccccgccggtccttctttgaatccttcatccggaccctcatcatcacgtgtgtggccctggctgtggtcctgtcctcggtctccatttgtgatgggcactggctcctggctgaggaccgcctcttcgggctctggcacttctgcaccaccaccaaccagagtgtgccgatctgcttcagagacctgggccaggcccatgtgcccgggctggccgtgggcatgggcctggtacgcagcgtgggcgccttggccgtggtggccgccatttttggcctggagttcctcatggtgtcccagttgtgcgaggacaaacactcacagtgcaagtgggtcatgggttccatcctcctcctggtgtctttcgtcctctcctccggcgggctcctgggttttgtgatcctcctcaggaaccaagtcacactcatcggcttcaccctaatgttttggtgcgaattcactgcctccttcctcctcttcctgaacgccatcagcggccttcacatcaacagcatcacccatccctgggaatgaccgtggaaattttaggccccctccagggacatcagattccacaagaaaatatggtcaaaatgggacttttccagcatgtggcctctggtggggctgggttggacaagggccttgaaacggctgcctgtttgccgataacttgtgggtggtcagccagaaatggccggggggcctctgcacctggtctgcagggccagaggccaggagggtgcctcagtgccaccaactgcacaggcttagccagatgttgattttagaggaagaaaaaaacattttaaaactccttcttgaattttcttccctggactggaatacagttggaagcacaggggtaactggtacctgagctagctgcacagccaaggatagttcatgcctgtttcattgacacgtgctgggataggggctgcagaatccctggggctcccagggttgttaagaatggatcattcttccagctaagggtccaatcagtgcctattcttccaccagctcaaagggccttcgtatgtatgtccctggcttcagctttggtcatgccaaagaggcagagttcaggattccctcagaatgccctgcacacagtaggtttccaaaccatttgactcggtttgcctccctgcccgttgtttaaaccttacaaaccctggataaccccatcttctagcagctggctgtcccctctgggagctctgcctatcagaaccctaccttaaggtgggtttccttccgagaagagttcttgagcaagctctcccaggagggcccacctgactgctaatacacagccctccccaaggcccgtgtgtgcatgtgtctgtcttttgtgagggttagacagcctcagggcaccatttttaatcccagaacacatttcaaagagcacgtatctagacctgctggactctgcagggggtgagggggaacagcgagagcttgggtaatgattaacacccatgctggggatgcatggaggtgaagggggccaggaaccagtggagatttccatccttgccagcacgtctgtacttctgttcattaaagtgctccctttctagtcctttttctgcccaga

SEQ ID NO: 437051 - DNA, 1993 bp, Homo sapiens
gtgaaaggatacccccgcaacaggacaggtcttcctttcccatgtgggctctttatccagaacccagagctgcggagagtctggcttctgggacccttgactggggagaaagcaggtgggggccacggagggaaggccccagagcagagaggcaccaggctggctgagcctgggcagctgccctttgccttagctcagtggttctcaaagcctggcccccaggccagcagcaccaacatcacttgaggccactcagccagaaactctgcagtggggcctcgcaatctgttttaacaaaccttccaggtgactctggtgcagaatggtggcaagaactcaaacctggactaggcctgctgggcccagaggcctttgggccaaaggcagccccgccggtccttctttgaatccttcatccggaccctcatcatcacgtgtgtggccctggctgtggtcctgtcctcggtctccatttgtgatgggcactggctcctggctgaggaccgcctcttcgggctctggcacttctgcaccaccaccaaccagagtgtgccgatctgcttcagagacctgggccaggcccatgtgcccgggctggccgtgggcatgggcctggtacgcagcgtgggcgccttggccgtggtggccgccatttttggcctggagttcctcatggtgtcccagttgtgcgaggacaaacactcacagtgcaagtgggtcatgggttccatcctcctcctggtgtctttcgtcctctcctccggcgggctcctgggttttgtgatcctcctcaggaaccaagtcacactcatcggcttcaccctaatgttttggtgcgaattcactgcctccttcctcctcttcctgaacgccatcagcggccttcacatcaacagcatcacccatccctgggaatgaccgtggaaattttaggccccctccagggacatcagattccacaagaaaatatggtcaaaatgggacttttccagcatgtggcctctggtggggctgggttggacaagggccttgaaacggctgcctgtttgccgataacttgtgggtggtcagccagaaatggccggggggcctctgcacctggtctgcagggccagaggccaggagggtgcctcagtgccaccaactgcacaggcttagccagatgttgattttagaggaagaaaaaaacattttaaaactccttcttgaattttcttccctggactggaatacagttggaagcacaggggtaactggtacctgagctagctgcacagccaaggatagttcatgcctgtttcattgacacgtgctgggataggggctgcagaatccctggggctcccagggttgttaagaatggatcattcttccagctaagggtccaatcagtgcctattcttccaccagctcaaagggccttcgtatgtatgtccctggcttcagctttggtcatgccaaagaggcagagttcaggattccctcagaatgccctgcacacagtaggtttccaaaccatttgactcggtttgcctccctgcccgttgtttaaaccttacaaaccctggataaccccatcttctagcagctggctgtcccctctgggagctctgcctatcagaaccctaccttaaggtgggtttccttccgagaagagttcttgagcaagctctcccaggagggcccacctgactgctaatacacagccctccccaaggcccgtgtgtgcatgtgtctgtcttttgtgagggttagacagcctcagggcaccatttttaatcccagaacacatttcaaagagcacgtatctagacctgctggactctgcagggggtgagggggaacagcgagagcttgggtaatgattaacacccatgctggggatgcatggaggtgaagggggccaggaaccagtggagatttccatccttgccagcacgtctgtacttctgttcattaaagtgctccctttctagtcctttttctgcccaga

SEQ ID NO: 437052 - DNA, 2444 bp, Homo sapiens
gttccctggcaggtggaaatcaggaggggagacgtggaaatgtccttccgggtgtggcagtgtgggggccagctggagatcatcccctgctctgtcgtaggccatgtgttccggaccaagagcccccacaccttccccaagggcactagtgtcattgctcgcaatcaagtgcgcctggcagaggtctggatggacagctacaagaagattttctataggagaaatctgcaggcagcaaagatggcccaagagaaatccttcggtgacatttcggaacgactgcagctgagggaacaactgcactgtcacaacttttcctggtacctgcacaatgtctacccagagatgtttgttcctgacctgacgcccaccttctatggtgccatcaagaacctcggcaccaaccaatgcctggatgtgggtgagaacaaccgcggggggaagcccctcatcatgtactcctgccacggccttggcggcaaccagtactttgagtacacaactcagagggaccttcgccacaacatcgcaaagcagctgtgtctacatgtcagcaagggtgctctgggccttgggagctgtcacttcactggcaagaatagccaggtccccaaggacgaggaatgggaattggcccaggatcagctcatcaggaactcaggatctggtacctgcctgacatcccaggacaaaaagccagccatggccccctgcaatcccagtgacccccatcagttgtggctctttgtctaggacccagatcatccccagagagagcccccacaagctcctcaggaaacaggattgctgatgtctgggaacctgatcaccagcttctctggaggccgtaaagatggatttctaaacccactgggtggcaaggcaggaccttcctaatccttgcaacaacattgggcccattttctttccttcacaccgatggaagagaccattaggacatatatttagcctagcgttttcctgttctagaaatagaggctcccaaagtagggaaggcagctgggggagggttcagggcagcaatgctgagttcaagaaaagtacttcaggctgggcacagtggctcatgcctgaaatcctagcactttgggaagacaatgtgggagaatggcttgagcccaggagttcaagaccggcctgagcaacatagtgaggatcccatctctacgcccaccctccccccggcaaaaaaaaaagctgggtatggtggcttatgcctgtagtcgcagctactcagaaggctgaggtgggaggattgcttgttccccggaggttgaagctacagtgagccttgattgtgtcactgcactccagcctgggcaacaggtaagactctgtctcaaaaaaaaaacaaaaaagaagaagaaaagtacttctacagccatgtcctattccttgatcatccaaagcacctgcagagtccagtgaaatgatatattctggctgggcacagtggctcacacctgtaatcctagcactttgggaggccaaggcaggtggatcacctgaggtcagaagtttgaaaccagcctggactacatggtgaaactccatctctactaaaagtacaaaaattagctgggcatgatggcacgcacctgcagtcccagctacttgggaggctgaggcaggagaatcactcgaacccaggaggcagaggttgcagtgagccaagacagcaccattgcaccccagcctgagcaacaagagcgaaactccatctcaggaaaaaaaaaaaaaaaaaaagtatattctaacagacagatcagaggtctaagagatcctcccttgctattattacctgaagtctgtagaactgtttacagatatctccttgacaggtgtcctttatcttactttatctgtacagtaatcctgtgagaaagacaggacagaaaccactgtgcctattttacagatacgaaaactgagacacaggtaaaggggcttgtctgtagtcccatagctagcagatggctggagccaagactgaggctcgttcttcaatgctgagccagggctccttccgctgcaccacaagaacgctagaccactcgccaccagccttctcattccctcttcctccattctaatcatttctagctggctggcctccacagagcataggaaaacagccagggccgggcacggtggctcatgcctgtaatctcaacactctgggaggccgagccgggtggataacctgaggtcaggaattcgagaccagcctggccaacatggtaaaaccccatctctactaaaaatataaaaattagccaggcatggtggcgcacacctgtaatcccagctactcaagaggctgaggcaggagaattgcttaaatctgggaggcggaagttgcagtgagccaagatcgcgccactgaactccagcctaggcaacaagagcaaaactccatctcc

SEQ ID NO: 437053 - DNA, 422 bp, Homo sapiens
tcacctgagggagctgataaactcacatttccaggtcaaaaagccaagtgatcagagctcagagtaggtatacaggcacaggtaacaaaaattaaccagcaggcttttccctaaagtgggccctggtaaacacaggaccctgcagtctccctgtgcttaagtcagagtgaaccaacatcagaaagcctgggatcgtgtagtcatggcctaggaagaagcctggtcggtatcctttttcccagggagagagagcagcatttgcccaagtccttggacctggggtctggtgctctgggaatagaatagagctgcttatggggagactgtctcacctagcccactgaaggcctcatcctgtctcctcttacatcaggtgtggcagtgtgggggccagctggagatcatcccctgctctgtcgtag

SEQ ID NO: 437054 - DNA, 306 bp, Homo sapiens
ttgagtacacaactcagagggaccttcgccacaacatcgcaaagcagctgtgtctacatgtcagcaagggtgctctgggccttgggagctgtcacttcactggcaagaatagccaggtccccaaggacgaggaatgggaattggcccaggtgagtcagtgtccagaaagctcagaatcaagaacttgaggccaggtgtggtggctcacgcctgtaatcccagcactttgagaggccgaggagggcagatcacgaggtcaggagttcgagaccacctggccaacatggtgaaaccccatctctacta

SEQ ID NO: 437055 - DNA, 3560 bp, Homo sapiens
atgaggctcctccgcagacgccacatgcccctgcgcctggccatggtgggctgcgcctttgtgctcttcctcttcctcctgcatagggatgtgagcagcagagaggaggccacagagaagccgtggctgaagtccctggtgagccggaaggatcacgtcctggacctcatgctggaggccatgaacaaccttagagattcaatgcccaagctccaaatcagggctccagaagcccagcagactctgttctccataaaccagtcctgcctccctgggttctataccccagctgaactgaagcccttctgggaacggccaccacaggaccccaatgcccctggggcagatggaaaagcatttcagaagagcaagtggacccccctggagacccaggaaaaggaagaaggctataagaagcactgtttcaatgcctttgccagcgaccggatctccctgcagaggtccctggggccagacacccgaccacctgagtgtgtggaccagaagttccggcgctgccccccactggccaccaccagcgtgatcattgtgttccacaacgaagcctggtccacactgctgcgaacagtgtacagcgtcctacacaccacccctgccatcttgctcaaggagatcatactggtggatgatgccagcacagaggagcacctaaaggagaagctggagcagtacgtgaagcagctgcaggtggtgagggtggtgcggcaggaggagcggaaggggttgatcaccgcccggctgctgggggccagcgtggcacaggcggaggtgctcacgttcctggatgcccactgtgagtgcttccacggctggctggagcccctcctggctcgaatcgctgaggacaagacagtggtggtgagcccagacatcgtcaccatcgaccttaatacttttgagttcgccaagcccgtccagaggggcagagtccatagccgaggcaactttgactggagcctgaccttcggctgggaaacacttcctccacatgagaagcagaggcgcaaggatgaaacataccccatcaaatccccgacgtttgctggtggcctcttctccatccccaagtcctactttgagcacatcggtacctatgataatcagatggagatctggggaggggagaacgtggaaatgtccttccgggtgtggcagtgtgggggccagctggagatcatcccctgctctgtcgtaggccatgtgttccggaccaagagcccccacaccttccccaagggcactagtgtcattgctcgcaatcaagtgcgcctggcagaggtctggatggacagctacaagaagattttctataggagaaatctgcaggcagcaaagatggcccaagagaaatccttcggtgacatttcggaacgactgcagctgagggaacaactgcactgtcacaacttttcctggtacctgcacaatgtctacccagagatgtttgttcctgacctgacgcccaccttctatggtgccatcaagaacctcggcaccaaccaatgcctggatgtgggtgagaacaaccgcggggggaagcccctcatcatgtactcctgccacggccttggcggcaaccagtactttgagtacacaactcagagggaccttcgccacaacatcgcaaagcagctgtgtctacatgtcagcaagggtgctctgggccttgggagctgtcacttcactggcaagaatagccaggtccccaaggacgaggaatgggaattggcccaggatcagctcatcaggaactcaggatctggtacctgcctgacatcccaggacaaaaagccagccatggccccctgcaatcccagtgacccccatcagttgtggctctttgtctaggacccagatcatccccagagagagcccccacaagctcctcaggaaacaggattgctgatgtctgggaacctgatcaccagcttctctggaggccgtaaagatggatttctaaacccactgggtggcaaggcaggaccttcctaatccttgcaacaacattgggcccattttctttccttcacaccgatggaagagaccattaggacatatatttagcctagcgttttcctgttctagaaatagaggctcccaaagtagggaaggcagctgggggagggttcagggcagcaatgctgagttcaagaaaagtacttcaggctgggcacagtggctcatgcctgaaatcctagcactttgggaagacaatgtgggagaatggcttgagcccaggagttcaagaccggcctgagcaacatagtgaggatcccatctctacgcccaccctccccccggcaaaaaaaaaagctgggtatggtggcttatgcctgtagtcgcagctactcagaaggctgaggtgggaggattgcttgttccccggaggttgaagctacagtgagccttgattgtgtcactgcactccagcctgggcaacaggtaagactctgtctcaaaaaaaaaacaaaaaagaagaagaaaagtacttctacagccatgtcctattccttgatcatccaaagcacctgcagagtccagtgaaatgatatattctggctgggcacagtggctcacacctgtaatcctagcactttgggaggccaaggcaggtggatcacctgaggtcagaagtttgaaaccagcctggactacatggtgaaactccatctctactaaaagtacaaaaattagctgggcatgatggcacgcacctgcagtcccagctacttgggaggctgaggcaggagaatcactcgaacccaggaggcagaggttgcagtgagccaagacagcaccattgcaccccagcctgagcaacaagagcgaaactccatctcaggaaaaaaaaaaaaaaaaaaagtatattctaacagacagatcagaggtctaagagatcctcccttgctattattacctgaagtctgtagaactgtttacagatatctccttgacaggtgtcctttatcttactttatctgtacagtaatcctgtgagaaagacaggacagaaaccactgtgcctattttacagatacgaaaactgagacacaggtaaaggggcttgtctgtagtcccatagctagcagatggctggagccaagactgaggctcgttcttcaatgctgagccagggctccttccgctgcaccacaagaacgctagaccactcgccaccagccttctcattccctcttcctccattctaatcatttctagctggctggcctccacagagcataggaaaacagccagggccgggcacggtggctcatgcctgtaatctcaacactctgggaggccgagccgggtggataacctgaggtcaggaattcgagaccagcctggccaacatggtaaaaccccatctctactaaaaatataaaaattagccaggcatggtggcgcacacctgtaatcccagctactcaagaggctgaggcaggagaattgcttaaatctgggaggcggaagttgcagtgagccaagatcgcgccactgaactccagcctaggcaacaagagcaaaactccatctcc

SEQ ID NO: 437056 - DNA, 2221 bp, Homo sapiens
gctatccctactttggaaccctctatttctagaacaggaaatcgctaggctaaatatatgtcctaatggtctcttccatcggtgtgaaggaaagaaaatgggcccaatgttgttgcaaggattaggaaggtcctgacctgacgcccaccttctatggtgccatcaagaacctcggcaccaaccaatgcctggatgtgggtgagaacaaccgcggggggaagcccctcatcatgtactcctgccacggccttggcggcaaccagtactttgagtacacaactcagagggaccttcgccacaacatcgcaaagcagctgtgtctacatgtcagcaagggtgctctgggccttgggagctgtcacttcactggcaagaatagccaggtccccaaggacgaggaatgggaattggcccaggatcagctcatcaggaactcaggatctggtacctgcctgacatcccaggacaaaaagccagccatggccccctgcaatcccagtgacccccatcagttgtggctctttgtctaggacccagatcatccccagagagagcccccacaagctcctcaggaaacaggattgctgatgtctgggaacctgatcaccagcttctctggaggccgtaaagatggatttctaaacccactgggtggcaaggcaggaccttcctaatccttgcaacaacattgggcccattttctttccttcacaccgatggaagagaccattaggacatatatttagcctagcgttttcctgttctagaaatagaggctcccaaagtagggaaggcagctgggggagggttcagggcagcaatgctgagttcaagaaaagtacttcaggctgggcacagtggctcatgcctgaaatcctagcactttgggaagacaatgtgggagaatggcttgagcccaggagttcaagaccggcctgagcaacatagtgaggatcccatctctacgcccaccctccccccggcaaaaaaaaaagctgggtatggtggcttatgcctgtagtcgcagctactcagaaggctgaggtgggaggattgcttgttccccggaggttgaagctacagtgagccttgattgtgtcactgcactccagcctgggcaacaggtaagactctgtctcaaaaaaaaaacaaaaaagaagaagaaaagtacttctacagccatgtcctattccttgatcatccaaagcacctgcagagtccagtgaaatgatatattctggctgggcacagtggctcacacctgtaatcctagcactttgggaggccaaggcaggtggatcacctgaggtcagaagtttgaaaccagcctggactacatggtgaaactccatctctactaaaagtacaaaaattagctgggcatgatggcacgcacctgcagtcccagctacttgggaggctgaggcaggagaatcactcgaacccaggaggcagaggttgcagtgagccaagacagcaccattgcaccccagcctgagcaacaagagcgaaactccatctcaggaaaaaaaaaaaaaaaaaaagtatattctaacagacagatcagaggtctaagagatcctcccttgctattattacctgaagtctgtagaactgtttacagatatctccttgacaggtgtcctttatcttactttatctgtacagtaatcctgtgagaaagacaggacagaaaccactgtgcctattttacagatacgaaaactgagacacaggtaaaggggcttgtctgtagtcccatagctagcagatggctggagccaagactgaggctcgttcttcaatgctgagccagggctccttccgctgcaccacaagaacgctagaccactcgccaccagccttctcattccctcttcctccattctaatcatttctagctggctggcctccacagagcataggaaaacagccagggccgggcacggtggctcatgcctgtaatctcaacactctgggaggccgagccgggtggataacctgaggtcaggaattcgagaccagcctggccaacatggtaaaaccccatctctactaaaaatataaaaattagccaggcatggtggcgcacacctgtaatcccagctactcaagaggctgaggcaggagaattgcttaaatctgggaggcggaagttgcagtgagccaagatcgcgccactgaactccagcctaggcaacaagagcaaaactccatctcc

SEQ ID NO: 437057 - DNA, 1923 bp, Homo sapiens
gggggccccccacgcggtcgcactggaattcgcagcccctctcgggtccccggggcgcattttgcagtctgagtggcaatgcacttgctccaggacaggcggctaccccgccgcagcggaggcgcggacttttcttttggggggtctcgccggctcgccgcgctccccaccttgcctgcgcccgcccggagccagcggttctccaagcacccagcatcctgctagacgcgccgcgcaccgacgtaggggacatgggcagagcaatggtggccaggctcgggctggggctgctgctgctggcactgctcctacccacgcagatttattccagtgaaacaacaactggaacttcaagtaactcctcccagagtacttccaacactgggttggccccaaatccaactaatgccaccaccaaggcggctggtggtgccctgcagtcaacagccagtctcttcgtggtctcactctctcttctgcatctctactcttaagagactcaggccaagaaacgtcttctaaacttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgtgattgtggaatggagattcagttttcatttggttcattaattctataaggccataaaacaggtaatataaaaagcttccatgattctatttatatgtacatgagaaggaacttccaggtgttactgtaattcctcaacgtattgtttcggcagcacttatttaatgccgatatactctagatgaagttttacattgttgagctattgctgttctcttgggaactgaactcactttcctcctgaggctttggatttgacattgcgtttgaccttttatgtagtaattgacatgtgccagggcaatgatgaatgagaatctacccccagatccaagcagcctgagcaactcttgattatccatattgagtcaaatggtaggcatttcctatcacctatttccattcaacaagagcactacattcatttagctaaacggattccaaagagtagaattgcattgaccgcgactaatttcaaaatgctttttattattattattttttagacagtctcactttgtcgcccaggctggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacctgcctcggcctcccaaagtgctgggattacaggcttgagcccccgcgcccagccatcaaaatgctttttatttctgcatatgttgaatactttttacaattaaaaaaaagatctgttttgaaggcaaaattgcaaatcttgaaattaagaaggaaaatgtaaaggagtcaaaactacaaatcaagtatttgggaagtgaagactggaagctaatttgcaaaattcacaaacttttatactctttctgtatatacttttttttctttaaaaaacaactatggatcagaatagccacatttggaatactttttgttatcagtcaatatttttagatagttagaacctggtccta

SEQ ID NO: 437058 - DNA, 1690 bp, Homo sapiens
  misc_feature (1)..(1): n is a, c, g, or t
ntatgccatgctagctctcacaatgaggctcctgttgcacatcgcaggcctcccacgtagggcattgagccataagcctacactggggtgaaacaacctctcgtgcaggccttcttgcgttcccgcccggtatcttctgaagccatcacttacattcgccgtccatttgctgtcaaagggggcaatgcgcccggtgtattacctgcatttctcggcggagaaaatcccactatgatacttggggtttcacacctaaaggtgtcgttcctccctaactccacaacccgagctcacaagcggccaccatgttgggacaggaacgcaggccacacctgttcactgctccacacgaagggtcccagatttctcacagagcgcaatcagatcggcacctcatgttcctcctcccagagtacttccaacactgggttggccccaaatccaactaatgccaccaccaaggcggctggtggtgccctgcagtcaacagccagtctcttcgtggtctcactctctcttctgcatctctactcttaagagactcaggccaagaaacgtcttctaaacttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgtgattgtggaatggagattcagttttcatttggttcattaattctataaggccataaaacaggtaatataaaaagcttccatgattctatttatatgtacatgagaaggaacttccaggtgttactgtaattcctcaacgtattgtttcggcagcacttatttaatgccgatatactctagatgaagttttacattgttgagctattgctgttctcttgggaactgaactcactttcctcctgaggctttggatttgacattgcgtttgaccttttatgtagtaattgacatgtgccagggcaatgatgaatgagaatctacccccagatccaagcagcctgagcaactcttgattatccatattgagtcaaatggtaggcatttcctatcacctatttccattcaacaagagcactacattcatttagctaaacggattccaaagagtagaattgcattgaccgcgactaatttcaaaatgctttttattattattattttttagacagtctcactttgtcgcccaggctggagtgcagtggtgcgatctcagatcagtgtaccatttgcctcccgggctcaagcgattctcctgcctcagcctgggtaacagagtgagacctcatctctacaaattttttttaaaaattagctgggggtgttggagcacagctgtggtcccagctacatgaggggctgaggcaggaggattttctgagcccaggaagtcaaggctgcagtgagccatgttcacaccattgcactccatcctgagtgacagagcaagaccctgtctcaaaaaaa

SEQ ID NO: 437059 - DNA, 899 bp, Homo sapiens
gggggccccccacgcggtcgcactggaattcgcagcccctctcgggtccccggggcgcattttgcagtctgagtggcaatgcacttgctccaggacaggcggctaccccgccgcagcggaggcgcggacttttcttttggggggtctcgccggctcgccgcgctccccaccttgcctgcgcccgcccggagccagcggttctccaagcacccagcatcctgctagacgcgccgcgcaccgacgtaggggacatgggcagagcaatggtggccaggctcgggctggggctgctgctgctggcactgctcctacccacgcagatttattccagtgaaacaacaactggaacttcaagtaactcctcccagagtacttccaacactgggttggccccaaatccaactaatgccaccaccaaggcggctggtggtgccctgcagtcaacagccagtctcttcgtggtctcactctctcttctgcatctctactcttaagagactcaggccaagaaacgtcttctaaacttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggtgctggtagcaaactaagatatttttctcttttatattacctgttttatggccttatagaattaatgaaccaaatgaaaactgaatctccattccacaatcccatcctttatttctattcttattttcaaggtagtattaagtgtccatatttctcaagccacattcaaggaaatcatgtct

SEQ ID NO: 437060 - DNA, 1647 bp, Homo sapiens
gggggccccccacgcggtcgcactggaattcgcagcccctctcgggtccccggggcgcattttgcagtctgagtggcaatgcacttgctccaggacaggcggctaccccgccgcagcggaggcgcggacttttcttttggggggtctcgccggctcgccgcgctccccaccttgcctgcgcccgcccggagccagcggttctccaagcacccagcatcctgctagacgcgccgcgcaccgacgtaggggacatgggcagagcaatggtggccaggctcgggctggggctgctgctgctggcactgctcctacccacgcagatttattccagtgaaacaacaactggaacttcaagtaactcctcccagagtacttccaacactgggttggccccaaatccaactaatgccaccaccaaggcggctggtggtgccctgcagtcaacagccagtctcttcgtggtctcactctctcttctgcatctctactcttaagagactcaggccaagaaacgtcttctaaacttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgtgattgtggaatggagattcagttttcatttggttcattaattctataaggccataaaacaggtaatataaaaagcttccatgattctatttatatgtacatgagaaggaacttccaggtgttactgtaattcctcaacgtattgtttcggcagcacttatttaatgccgatatactctagatgaagttttacattgttgagctattgctgttctcttgggaactgaactcactttcctcctgaggctttggatttgacattgcgtttgaccttttatgtagtaattgacatgtgccagggcaatgatgaatgagaatctacccccagatccaagcagcctgagcaactcttgattatccatattgagtcaaatggtaggcatttcctatcacctatttccattcaacaagagcactacattcatttagctaaacggattccaaagagtagaattgcattgaccgcgactaatttcaaaatgctttttattattattattttttagacagtctcactttgtcgcccaggctggagtgcagtggtgcgatctcagatcagtgtaccatttgcctcccgggctcaagcgattctcctgcctcagcctgggtaacagagtgagacctcatctctacaaattttttttaaaaattagctgggggtgttggagcacagctgtggtcccagctacatgaggggctgaggcaggaggattttctgagcccaggaagtcaaggctgcagtgagccatgttcacaccattgcactccatcctgagtgacagagcaagaccctgtctcaaaaaaa

SEQ ID NO: 437061 - DNA, 1926 bp, Homo sapiens
gggggccccccacgcggtcgcactggaattcgcagcccctctcgggtccccggggcgcattttgcagtctgagtggcaatgcacttgctccaggacaggcggctaccccgccgcagcggaggcgcggacttttcttttggggggtctcgccggctcgccgcgctccccaccttgcctgcgcccgcccggagccagcggttctccaagcacccagcatcctgctagacgcgccgcgcaccgacgtaggggacatgggcagagcaatggtggccaggctcgggctggggctgctgctgctggcactgctcctacccacgcagatttattccagtgaaacaacaactggaacttcaagtaactcctcccagagtacttccaacactgggttggccccaaatccaactaatgccaccaccaaggcggctggtggtgccctgcagtcaacagccagtctcttcgtggtctcactctctcttctgcatctctactcttaagagactcaggccaagaaacgtcttctaaacttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgtgattgtggaatggagattcagttttcatttggttcattaattctataaggccataaaacaggtaatataaaaagcttccatgattctatttatatgtacatgagaaggaacttccaggtgttactgtaattcctcaacgtattgtttcggcagcacttatttaatgccgatatactctagatgaagttttacattgttgagctattgctgttctcttgggaactgaactcactttcctcctgaggctttggatttgacattgcgtttgaccttttatgtagtaattgacatgtgccagggcaatgatgaatgagaatctacccccagatccaagcagcctgagcaactcttgattatccatattgagtcaaatggtaggcatttcctatcacctatttccattcaacaagagcactacattcatttagctaaacggatgctcacagactggacaggcactggccatctctaggagcactaggcgagttgtgaatgtgctaatctagacacttcggagaaagtctcttactctaatctgcaaatggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacctgcctcggcctcccaaagtgctgggattacaggcttgagcccccgcgcccagccatcaaaatgctttttatttctgcatatgttgaatactttttacaattaaaaaaaagatctgttttgaaggcaaaattgcaaatcttgaaattaagaaggaaaatgtaaaggagtcaaaactacaaatcaagtatttgggaagtgaagactggaagctaatttgcaaaattcacaaacttttatactctttctgtatatacttttttttctttaaaaaacaactatggatcagaatagccacatttggaatactttttgttatcagtcaatatttttagatagttagaacctggtccta

SEQ ID NO: 437062 - DNA, 306 bp, Homo sapiens
actgattgattgattgattgattgattgattgatagacgggtggatagagatgtttaaagttcaacaaaaataaggatagtatacttttatccttataaatataataaacattataagaatgttgaaaccctttcaaaatcacttattttttaacttagaattttttgaagaaatattaccagtaatattttcaaatcctaagaattatgctttacttaaataaaatgatattaaattaaaacctgtatgtaaaagtacatattaaagcacaatatgtgtgtgtgtttttttaagttaggacagta

SEQ ID NO: 437063 - DNA, 4145 bp, Homo sapiens
atcagaaacccgaaggcccgaggatctgggcacgacagcggttaagcaagcgcagagcaagtcgctggccgcgcaatgcccggtgggtcttgcagtttcttggctgggcatggccggaagggaggagagaaggacgcattgcatggcgggagatatagtctttgccggaagtccctcctccctcggacgcctggcggcgccggcgcacactgctcttccttaagggcgggagtctcggtttgtggtggcttcgctgaggcagtggtggccgcactataccgttagaaactcaatttcccggaggttgtgaggccctttgaggcgaaatcgctctgggcgtgaaaggagcaggcgttggcaatggaaggaccaccgcgacctcaggctgaccgtagggagggatcttgagggccctccgagtcccctgggcttgcgctttctttctttgcagccaccgtgcctaccgcgaggatgagctcggcctcggtcaccgctttcgagaaggagcatctctggatgtatctgcaggcgctcggcttcgagccaggcccggcaaccattgcctgcggaaagatcgtgtcgcacacgcacctcggagtgaacatgtttgacaagctgaaccgtgatgcctttcatataatttcttattttttgtttcaagttctggaccagtctctcaccaaagaagttttcaaattttgttggcccccatttgaccaaaaaagtgacactgaattccgaaaacattgctgtgaatggataaaaaggatttctggtgaatgtggaagtagctttcctcaagttgttggttcactatttctttctcctggtggtcctaagtttattcatctgatgtatcattttgcaagatttgttgcaatgaaatatattaaatccaattctaaaaattcttctcatcattttgtagagacatttaacataaaaccacaggacttgcacaaatgcattgccagatgccatttcgcacgtagcagatttttacaaattttgcaaagacaagattgtgttacccaaaaatatcaggaaaatgcacaattatcagttaagcaggtacgaaacttgagatctgaatgtataggattggaaaaccaaataaagaaaatggaaccctatgatgaccacagtaatatggaagaaaaaattcaaaaggttcggtctttgtgggcttcagtgaatgaaacgctcatgtttttggaaaaagagagagaagttgttagttcggtccttagtcttgttaaccaatatgctttagatggaactaatgttgctattaatattccaaggctcttacttgacaaaattgagaaacaaatgtttcagttgcacataggaaatgtttatgaggctggaaaactgaacctcttaacagttattcagttattaaatgaagtcttgaaggtgatgaaatatgaacgttgtcaggctgatcaagcaagattgacggtagaccttcactaccttgaaaaagagaccaaatttcagaaggaaagattatcagatctgaaacatatgaggtatagaataaaagatgatctcacaactataagacattctgttgttgaaaagcaaggagaatggcataaaaagtggaaagaatttcttggtttgtctcctttcagtctaattaaaggttggactccatctgtagatcttttaccaccaatgtctcccctttcgtttgatcctgcctcagaagaagtgtatgcaaagagtattctttgtcagtatcctgcttcacttccagatgcacataagcaacataaccaagaaaatggttgcagaggagacagtgataccttgggagcgctacatgatctagccaacagccctgcctctttcttgtcgcagtcagtttcatcatcagatagaaacagtgttacagtacttgaaaaggacacaaagatgggaactcccaaagaaaaaaatgaagcaatttctaagaaaataccagaatttgaagtggaaaattctccattatcagatgttgcaaagaatacagagagtagtgcatttggagggtctttgccagctaaaaaaagtgatccatttcaaaaagagcaagatcatctggtagaagaggttgccagagcagttttatctgattcaccacagctctctgaaggaaaagaaataaaattagaggaactaattgactctctgggttctaaccccttcttaacaaggaatcagattccccgtactccagaaaacttgataactgaaattaggagctcatggagaaaagctattgaaatggaagaaaacagaactaaagaaccaattcaaatggatgctgaacatagagaagtattgccagaatcattacctgtgttgcacaatcaaagagaatttagcatggctgattttctcttagaaaccactgtatcagattttggccagtctcatttgactgaagagaaagttatttcagattgcgagtgtgtgcctcagaaacatgtgctgaccagtcacatagatgaaccaccaacacaaaatcagtcagatttgttaaataagaaagtaatttgcaagcaagatttggaatgtttagccttcaccaagctttcagaaactagccgaatggagacattctcccctgctgtcggcaataggatagatgtgatgggtggcagtgaagaggagtttatgaaaatattggaccacttagaagtttcttgtaacaaaccttccacaaataaaactatgttgtggaattcttttcagatatcaagtggaattagttctaagagttttaaagataatgattttggcatattacacgaaactctcccggaagaagttggtcatctaagttttaatagttccagtagttcagaggccaattttaaactggagccaaatagtcctatgcatggtggcactcttctagaagatgttgtgggagggagacagactactccagaatcagactttaatttacaggctcttcgcagtagatacgaggctctgaagaaatctctttccaagaaaagggaagaatcttacctctcgaattcccaaacacccgaaagacacaaaccagaattgagccctactccccaaaatgtacaaacagatgatacgcttaactttttggacacctgtgatttgcatactgagcatataaagccatctttacgcacgtccatcggtgaaagaaaacggtctctttcaccactaattaagttttctccagtggaacaaagattgagaaccacaatagcatgtagtcttggagaactacctaatttaaaggaagaagacattttgaataagagccttgatgcaaaagaaccaccgtctgacttgacaagatgaagacgtacccatttaatataactatgatgcacttaaattgaagctatgccacaggatagaaaatgaattacaacttaaatacatgttggaagtgtaacactgtttttcaaggtttaaaaaaattcctaatgccttttagccttctttaatatttttaggtaaggaaagtatgtttggattttttcctctttgtaggtatatgagattgaaatgtgaagtatttggacaacaaacgtcaagcaatgggaagccattttgatttcttgagtaatcttgtaagcattaagtgaatgacaaagtagtagtgtaacttatttcttatgttataacttcagtcaattaatataaggatagtttttgttgtatgttcactaagtggttaatataatagccattgaatatactaatctttcatcttagagaactatacaacttttattgtttcttaatggaacattctggctaaccagaaaaagtgagaaaagtagtaccttgggatgtgtagtcaagatgacaaattttaagactggaaaagctctaaacaggcttaatgattcttcaggtagaatgatcctgagaagtgatgtttgatggaataaagtgcatgtgatgattaagtgaagactggggcagaatgatttaaaaaaaggaaaaagatggaagatgagtagacacttgcaaggaacactgtcaaactataaatccattcagtgggttgtataacatttatatttagtctaatttagactttgataatttaatgctacttttatattttaacaaaaatataaattaaaattttcatt

SEQ ID NO: 437064 - DNA, 5160 bp, Homo sapiens
accccattctcaagtggcatttactcatcgattccatcaatccatcaaatagttaacatccctgcctctttcttgtcgcagtcagtttcatcatcagatagaaacagtgttacagtacttgaaaaggacacaaagatgggaactcccaaagaaaaaaatgaagcaatttctaagaaaataccagaatttgaagtggaaaattctccattatcagatgttgcaaagaatacagagagtagtgcatttggagggtctttgccagctaaaaaaagtgatccatttcaaaaagagcaagatcatctggtagaagaggttgccagagcagttttatctgattcaccacagctctctgaaggaaaagaaataaaattagaggaactaattgactctctgggttctaaccccttcttaacaaggaatcagattccccgtactccagaaaacttgataactgaaattaggagctcatggagaaaagctattgaaatggaagaaaacagaactaaagaaccaattcaaatggatgctgaacatagagaagtattgccagaatcattacctgtgttgcacaatcaaagagaatttagcatggctgattttctcttagaaaccactgtatcagattttggccagtctcatttgactgaagagaaagttatttcagattgcgagtgtgtgcctcagaaacatgtgctgaccagtcacatagatgaaccaccaacacaaaatcagtcagatttgttaaataagaaagtaatttgcaagcaagatttggaatgtttagccttcaccaagctttcagaaactagccgaatggagacattctcccctgctgtcggcaataggatagatgtgatgggtggcagtgaagaggagtttatgaaaatattggaccacttagaagtttcttgtaacaaaccttccacaaataaaactatgttgtggaattcttttcagatatcaagtggaattagttctaagagttttaaagataatgattttggcatattacacgaaactctcccggaagaagttggtcatctaagttttaatagttccagtagttcagaggccaattttaaactggagccaaatagtcctatgcatggtggcactcttctagaagatgttgtgggagggagacagactactccagaatcagactttaatttacaggctcttcgcagtagatacgaggctctgaagaaatctctttccaagaaaagggaagaatcttacctctcgaattcccaaacacccgaaagacacaaaccagaattgagccctactccccaaaatgtacaaacagatgatacgcttaactttttggacacctgtgatttgcatactgagcatataaagccatctttacgcacgtccatcggtgaaagaaaacggtctctttcaccactaattaagttttctccagtggaacaaagattgagaaccacaatagcatgtagtcttggagaactacctaatttaaaggaagaagacattttgaataagagccttgatgcaaaagaaccaccgtctgacttgacaagatgaagacgtacccatttaatataactatgatgcacttaaattgaagctatgccacaggatagaaaatgaattacaacttaaatacatgttggaagtgtaacactgtttttcaaggtttaaaaaaattcctaatgccttttagccttctttaatatttttaggtaaggaaagtatgtttggattttttcctctttgtaggtatatgagattgaaatgtgaagtatttggacaacaaacgtcaagcaatgggaagccattttgatttcttgagtaatcttgtaagcattaagtgaatgacaaagtagtagtgtaacttatttcttatgttataacttcagtcaattaatataaggatagtttttgttgtatgttcactaagtggttaatataatagccattgaatatactaatctttcatcttagagaactatacaacttttattgtttcttaatggaacattctggctaaccagaaaaagtgagaaaagtagtaccttgggatgtgtagtcaagatgacaaattttaagactggaaaagctctaaacaggcttaatgattcttcaggtagaatgatcctgagaagtgatgtttgatggaataaagtgcatgtgatgattaagtgaagactggggcagaatgatttaaaaaaaggaaaaagatggaagatgagtagacacttgcaaggaacactgtcaaactataaatccattcagtgggttgtataacatttatatttagtctaatttagactttgataatttaatgctacttttatattttaacaaaaatataaattaaaattttcattagtctgttttgttgttgggtttttttgtgaggtactccctgttgggggaaaggaacaaggaacaaccatcagaatcccccagtccctacagaatagcctcacagtaacttgagaaaactgaacttggggttaaataacttgtcacacttgcagtctcctgcctcactccttcaggtgccctgcctagaaaaagacttgtgtctagcatccaagtgaacacatactattgccctctgtgaaccaggaggaatggaacaggcaatggaagggtgatagtacctacaataccctttgtagaccccatctcactaccatcaaaatcttgtccactagcccccaaaaaactggcaaggaaagaaggtggaggggaaatttatggaagtagatggcttaatagttatttcttttatcttgggctgcctttctctaagttggttgtcctgtcccagtgtgaagacccatctttttgtgagaaaagacaaaagaaagcacatgtaactaccttctttgcaatggaaaaggagaaagaaaaaatcttctcctaagttgctgttttcttttattagttaataaaacaaatcagggactatgcaggtctatggggaaacctttagtctgctttaagaaaactcagtatctgaaaatcttaacttagcatgtgatactgtcttatcagcatctgcagaagtgccaaagccactgctagacacttaatgtgtattatttcatttaattatattttaaatgtgcttccttggtaattcttaagctcgagaaagagtttgagaactgctgctaggaaatagagattcacatttaaccctgtggtacttttaagaagcaggtacgttgttgcatatatacttgggtagagattggtaactatctgatagggaagctcaagttggccacccaagtctgagaaacccttaattactgagaatcaaaagagcagaatgtctgtagacattttggatttgtaaaaatcacattgttgagttatacctgtgatgggctgaaagtttttggcattctttcctgttcttcatatgccagtaccataaacaaaaagtatctcagatctgtcactttcttctcctaaaccaatgtgattgcagctttttgccttcagccttttccctatccagtatctcctacatagttaccttttgatcttaaggaactgttttgattgggtcacttccttgcctaaaattccattgattgttcattgttaattctaaaatagagttcaaatttaaaggcatgtaagttcccctgtaacggatttcctctactcccccttccgctgtaatctcccatttttttactgaaatgcttcagtgagcatgggtctttagaggtcttgatatacaattttcctgaagcaggaataccttgctttcctctactagtttaccacaattacagctctcttttaagcctcagaaaaaaatctcacttccgtcttgaagtcttaatccacgctttttatatccatgtgcctactccttctctgaaatctcctatggtttatctttttattcatttaatatcccacgaattgattttattatatattttttatggttgcatgtggtctttctagttatagcaatatacacatacatgcataaatacatatacacctatgtaaatgtgtgttgggagtatgtattcacacacatacatataccccaaggccatgtgtcatctttatcaatatttaagttttggaattgttttgtttgcctcctatatcatggaataaatggtaaagagggctaatttattactctaagtggatttcttattacattaatatcagacatatagaatgtactttgttttactatttgtaagatacaaaggtatataaactgacatacatcagcttgaaacctgagataatgctaaaatgttctaattattttaaatgtttaaagaggacaaccatgtaatgttgctaaacatgaaaaatgtcatcaagtggaataaagaatagctgaagttaacatttgggggaaattgagctgaaaacaaaaatatgagtattttgataccttttctttaccatgagactcttgactatgaagtcaaatttatctaaaggaaaaacaggaattctggagacctgtgtaaaagcagactattatcttcctactgtgagagtactaaaattaaaatacgtttaatgacgttttcctcaatgtaaaagcattgaagtaaatgtttcttttatgttgcagatacatagttgctctagagatcacctttttctttatgcattgtgaatagcagtctgcatcctaagtttaaaatatttgagaatcctctatgggactctctgtaaatgttttaaatactgttgttttcaataaatattttatactatctggctctggaatttcctatataatctcaaaaagaactatgcccctgcaaatcataagatgatcacatgtaaagttatattaataacctgatcaacaaatttgagaggttcagtgattcaggtcaacatattttgttacttccattttaattactagatttacagtatatagtattttaaaatgaatttttaaggttatatctatactgtcagtttacacatctggagtctttatactaatgtattgccaatggccctaattaggtaatttttataaattacacctgaatagcttcttactcttcatgagtagcgtcatccacatctgctgctagaaagggtttaatgaacattaaataattttataaagccttagaaattctaaagccctatcacttatgtttactg

SEQ ID NO: 437065 - DNA, 4944 bp, Homo sapiens
tagagataaacctatgttctgacccacctagtagggtctttgccagctaaaaaaagtgatccatttcaaaaagagcaagatcatctggtagaagaggttgccagagcagttttatctgattcaccacagctctctgaaggaaaagaaataaaattagaggaactaattgactctctgggttctaaccccttcttaacaaggaatcagattccccgtactccagaaaacttgataactgaaattaggagctcatggagaaaagctattgaaatggaagaaaacagaactaaagaaccaattcaaatggatgctgaacatagagaagtattgccagaatcattacctgtgttgcacaatcaaagagaatttagcatggctgattttctcttagaaaccactgtatcagattttggccagtctcatttgactgaagagaaagttatttcagattgcgagtgtgtgcctcagaaacatgtgctgaccagtcacatagatgaaccaccaacacaaaatcagtcagatttgttaaataagaaagtaatttgcaagcaagatttggaatgtttagccttcaccaagctttcagaaactagccgaatggagacattctcccctgctgtcggcaataggatagatgtgatgggtggcagtgaagaggagtttatgaaaatattggaccacttagaagtttcttgtaacaaaccttccacaaataaaactatgttgtggaattcttttcagatatcaagtggaattagttctaagagttttaaagataatgattttggcatattacacgaaactctcccggaagaagttggtcatctaagttttaatagttccagtagttcagaggccaattttaaactggagccaaatagtcctatgcatggtggcactcttctagaagatgttgtgggagggagacagactactccagaatcagactttaatttacaggctcttcgcagtagatacgaggctctgaagaaatctctttccaagaaaagggaagaatcttacctctcgaattcccaaacacccgaaagacacaaaccagaattgagccctactccccaaaatgtacaaacagatgatacgcttaactttttggacacctgtgatttgcatactgagcatataaagccatctttacgcacgtccatcggtgaaagaaaacggtctctttcaccactaattaagttttctccagtggaacaaagattgagaaccacaatagcatgtagtcttggagaactacctaatttaaaggaagaagacattttgaataagagccttgatgcaaaagaaccaccgtctgacttgacaagatgaagacgtacccatttaatataactatgatgcacttaaattgaagctatgccacaggatagaaaatgaattacaacttaaatacatgttggaagtgtaacactgtttttcaaggtttaaaaaaattcctaatgccttttagccttctttaatatttttaggtaaggaaagtatgtttggattttttcctctttgtaggtatatgagattgaaatgtgaagtatttggacaacaaacgtcaagcaatgggaagccattttgatttcttgagtaatcttgtaagcattaagtgaatgacaaagtagtagtgtaacttatttcttatgttataacttcagtcaattaatataaggatagtttttgttgtatgttcactaagtggttaatataatagccattgaatatactaatctttcatcttagagaactatacaacttttattgtttcttaatggaacattctggctaaccagaaaaagtgagaaaagtagtaccttgggatgtgtagtcaagatgacaaattttaagactggaaaagctctaaacaggcttaatgattcttcaggtagaatgatcctgagaagtgatgtttgatggaataaagtgcatgtgatgattaagtgaagactggggcagaatgatttaaaaaaaggaaaaagatggaagatgagtagacacttgcaaggaacactgtcaaactataaatccattcagtgggttgtataacatttatatttagtctaatttagactttgataatttaatgctacttttatattttaacaaaaatataaattaaaattttcattagtctgttttgttgttgggtttttttgtgaggtactccctgttgggggaaaggaacaaggaacaaccatcagaatcccccagtccctacagaatagcctcacagtaacttgagaaaactgaacttggggttaaataacttgtcacacttgcagtctcctgcctcactccttcaggtgccctgcctagaaaaagacttgtgtctagcatccaagtgaacacatactattgccctctgtgaaccaggaggaatggaacaggcaatggaagggtgatagtacctacaataccctttgtagaccccatctcactaccatcaaaatcttgtccactagcccccaaaaaactggcaaggaaagaaggtggaggggaaatttatggaagtagatggcttaatagttatttcttttatcttgggctgcctttctctaagttggttgtcctgtcccagtgtgaagacccatctttttgtgagaaaagacaaaagaaagcacatgtaactaccttctttgcaatggaaaaggagaaagaaaaaatcttctcctaagttgctgttttcttttattagttaataaaacaaatcagggactatgcaggtctatggggaaacctttagtctgctttaagaaaactcagtatctgaaaatcttaacttagcatgtgatactgtcttatcagcatctgcagaagtgccaaagccactgctagacacttaatgtgtattatttcatttaattatattttaaatgtgcttccttggtaattcttaagctcgagaaagagtttgagaactgctgctaggaaatagagattcacatttaaccctgtggtacttttaagaagcaggtacgttgttgcatatatacttgggtagagattggtaactatctgatagggaagctcaagttggccacccaagtctgagaaacccttaattactgagaatcaaaagagcagaatgtctgtagacattttggatttgtaaaaatcacattgttgagttatacctgtgatgggctgaaagtttttggcattctttcctgttcttcatatgccagtaccataaacaaaaagtatctcagatctgtcactttcttctcctaaaccaatgtgattgcagctttttgccttcagccttttccctatccagtatctcctacatagttaccttttgatcttaaggaactgttttgattgggtcacttccttgcctaaaattccattgattgttcattgttaattctaaaatagagttcaaatttaaaggcatgtaagttcccctgtaacggatttcctctactcccccttccgctgtaatctcccatttttttactgaaatgcttcagtgagcatgggtctttagaggtcttgatatacaattttcctgaagcaggaataccttgctttcctctactagtttaccacaattacagctctcttttaagcctcagaaaaaaatctcacttccgtcttgaagtcttaatccacgctttttatatccatgtgcctactccttctctgaaatctcctatggtttatctttttattcatttaatatcccacgaattgattttattatatattttttatggttgcatgtggtctttctagttatagcaatatacacatacatgcataaatacatatacacctatgtaaatgtgtgttgggagtatgtattcacacacatacatataccccaaggccatgtgtcatctttatcaatatttaagttttggaattgttttgtttgcctcctatatcatggaataaatggtaaagagggctaatttattactctaagtggatttcttattacattaatatcagacatatagaatgtactttgttttactatttgtaagatacaaaggtatataaactgacatacatcagcttgaaacctgagataatgctaaaatgttctaattattttaaatgtttaaagaggacaaccatgtaatgttgctaaacatgaaaaatgtcatcaagtggaataaagaatagctgaagttaacatttgggggaaattgagctgaaaacaaaaatatgagtattttgataccttttctttaccatgagactcttgactatgaagtcaaatttatctaaaggaaaaacaggaattctggagacctgtgtaaaagcagactattatcttcctactgtgagagtactaaaattaaaatacgtttaatgacgttttcctcaatgtaaaagcattgaagtaaatgtttcttttatgttgcagatacatagttgctctagagatcacctttttctttatgcattgtgaatagcagtctgcatcctaagtttaaaatatttgagaatcctctatgggactctctgtaaatgttttaaatactgttgttttcaataaatattttatactatctggctctggaatttcctatataatctcaaaaagaactatgcccctgcaaatcataagatgatcacatgtaaagttatattaataacctgatcaacaaatttgagaggttcagtgattcaggtcaacatattttgttacttccattttaattactagatttacagtatatagtattttaaaatgaatttttaaggttatatctatactgtcagtttacacatctggagtctttatactaatgtattgccaatggccctaattaggtaatttttataaattacacctgaatagcttcttactcttcatgagtagcgtcatccacatctgctgctagaaagggtttaatgaacattaaataattttataaagccttagaaattctaaagccctatcacttatgtttactg

SEQ ID NO: 437066 - DNA, 4150 bp, Homo sapiens
  misc_feature (3343)..(3343): n is a, c, g, or t
atcagaaacccgaaggcccgaggatctgggcacgacagcggttaagcaagcgcagagcaagtcgctggccgcgcaatgcccggtgggtcttgcagtttcttggctgggcatggccggaagggaggagagaaggacgcattgcatggcgggagatatagtctttgccggaagtccctcctccctcggacgcctggcggcgccggcgcacactgctcttccttaagggcgggagtctcggtttgtggtggcttcgctgaggcagtggtggccgcactataccgttagaaactcaatttcccggaggttgtgaggccctttgaggcgaaatcgctctgggcgtgaaaggagcaggcgttggcaatggaaggaccaccgcgacctcaggctgaccgtagggagggatcttgagggccctccgagtcccctgggcttgcgctttctttctttgcagccaccgtgcctaccgcgaggatgagctcggcctcggtcaccgctttcgagaaggagcatctctggatgtatctgcaggcgctcggcttcgagccaggcccggcaaccattgcctgcggaaagatcgtgtcgcacacgcacctcggagtgaacatgtttgacaagctgaaccgtgatgcctttcatataatttcttattttttgtttcaagttctggaccagtctctcaccaaagaagttttcaaattttgttggcccccatttgaccaaaaaagtgacactgaattccgaaaacattgctgtgaatggataaaaaggatttctggtgaatgtggaagtagctttcctcaagttgttggttcactatttctttctcctggtggtcctaagtttattcatctgatgtatcattttgcaagatttgttgcaatgaaatatattaaatccaattctaaaaattcttctcatcattttgtagagacatttaacataaaaccacaggacttgcacaaatgcattgccagatgccatttcgcacgtagcagatttttacaaattttgcaaagacaagattgtgttacccaaaaatatcaggaaaatgcacaattatcagttaagcaggtacgaaacttgagatctgaatgtataggattggaaaaccaaataaagaaaatggaaccctatgatgaccacagtaatatggaagaaaaaattcaaaaggttcggtctttgtgggcttcagtgaatgaaacgctcatgtttttggaaaaagagagagaagttgttagttcggtccttagtcttgttaaccaatatgctttagatggaactaatgttgctattaatattccaaggctcttacttgacaaaattgagaaacaaatgtttcagttgcacataggaaatgtttatgaggctggaaaactgaacctcttaacagttattcagttattaaatgaagtcttgaaggtgatgaaatatgaacgttgtcaggctgatcaagcaagattgacggtagaccttcactaccttgaaaaagagaccaaatttcagaaggaaagattatcagatctgaaacatatgaggtatagaataaaagatgatctcacaactataagacattctgttgttgaaaagcaaggagaatggcataaaaagtggaaagaatttcttggtttgtctcctttcagtctaattaaaggttggactccatctgtagatcttttaccaccaatgtctcccctttcgtttgatcctgcctcagaagaagtgtatgcaaagagtattctttgtcagtatcctgcttcacttccagatgcacataagcaacataaccaagaaaatggttgcagaggagacagtgataccttgggagcgctacatgatctagccaacagccctgcctctttcttgtcgcagtcagtttcatcatcagatagaaacagtgttacagtacttgaaaaggacacaaagatgggaactcccaaagaaaaaaatgaagcaatttctaagaaaataccagaatttgaagtggaaaattctccattatcagatgttgcaaagaatacagagagtagtgcatttggagggtctttgccagctaaaaaaagtgatccatttcaaaaagagcaagatcatctggtagaagaggttgccagagcagttttatctgattcaccacagctctctgaaggaaaagaaataaaattagaggaactaattgactctctgggttctaaccccttcttaacaaggaatcagattccccgtactccagaaaacttgataactgaaattaggagctcatggagaaaagctattgaaatggaagaaaacagaactaaagaaccaattcaaatggatgctgaacatagagaagtattgccagaatcattacctgtgttgcacaatcaaagagaatttagcatggctgattttctcttagaaaccactgtatcagattttggccagtctcatttgactgaagagaaagttatttcagattgcgagtgtgtgcctcagaaacatgtgctgaccagtcacatagatgaaccaccaacacaaaatcagtcagatttgttaaataagaaagtaatttgcaagcaagatttggaatgtttagccttcaccaagctttcagaaactagccgaatggagacattctcccctgctgtcggcaataggatagatgtgatgggtggcagtgaagaggagtttatgaaaatattggaccacttagaagtttcttgtaacaaaccttccacaaataaaactatgttgtggaattcttttcagatatcaagtggaattagttctaagagttttaaagataatgattttggcatattacacgaaactctcccggaagaagttggtcatctaagttttaatagttccagtagttcagaggccaattttaaactggagccaaatagtcctatgcatggtggcactcttctagaagatgttgtgggagggagacagactactccagaatcagactttaatttacaggctcttcgcagtagatacgaggctctgaagaaatctctttccaagaaaagggaagaatcttacctctcgaattcccaaacacccgaaagacacaaaccagaattgagccctactccccaaaatgtacaaacagatgatacgcttaactttttggacacctgtgatttgcatactgagcatataaagccatctttacgcacgtccatcggtgaaagaaaacggtctctttcaccactaattaagttttctccagtggaacaaagattgagaaccacaatagcatgtagtcttggagaactacctaatttaaagggtaaggtttaaatagacctatgcatattcacctgttgaagttttctctcaacttttgataaaaccngtacacaaagaatgctgcatgacctttattgttaatgtgctcccccttccttcatttaggatgaggggaatgatccctcactggacaggtcctttcagaatctctgtttatgtatatatagttacaattgatttgagacaggggtgggaaaaaaaagcccccccaatctgaagcttacaggttttataatacaaatgactgaaaagtaaatgtcatcaaaatcttgcccagtggaaggtggtttttaaacacttgagaaacccaattttaaatatcatcactataatggtgtaatatctgggggtggggtgtagaaataaaagaagccaggtcagtgtattagtttcctagggctgccataacaaagcaccatcaagtgggtggcttagaacagcagaaatttattgtctctggagacagtaagttctagaggctagatgtccaaaatcaaggtgttgacagggccatgttccctctgaagccactagaagaggatccttctttgcctcttctagcctctggtagcaccaggcattccttggcttgtggcagtgtaattctaatctttgcctccattgtcacatggtattcttcccttgtgtgtgtattgtcttataaggacacagtcatattagctaattaatgggtcaccctactccagtatgacctcatcttacttagctaattatatctgtaatgaccacatttccaaataaggtcacattctgaggtactggggttagaacttcaacatatgtttttgggggtattcagttcataacagttagtattaataattattgaagc

SEQ ID NO: 437067 - DNA, 6948 bp, Homo sapiens
atcagaaacccgaaggcccgaggatctgggcacgacagcggttaagcaagcgcagagcaagtcgctggccgcgcaatgcccggtgggtcttgcagtttcttggctgggcatggccggaagggaggagagaaggacgcattgcatggcgggagatatagtctttgccggaagtccctcctccctcggacgcctggcggcgccggcgcacactgctcttccttaagggcgggagtctcggtttgtggtggcttcgctgaggcagtggtggccgcactataccgttagaaactcaatttcccggaggttgtgaggccctttgaggcgaaatcgctctgggcgtgaaaggagcaggcgttggcaatggaaggaccaccgcgacctcaggctgaccgtagggagggatcttgagggccctccgagtcccctgggcttgcgctttctttctttgcagccaccgtgcctaccgcgaggatgagctcggcctcggtcaccgctttcgagaaggagcatctctggatgtatctgcaggcgctcggcttcgagccaggcccggcaaccattgcctgcggaaagatcgtgtcgcacacgcacctcggagtgaacatgtttgacaagctgaaccgtgatgcctttcatataatttcttattttttgtttcaagttctggaccagtctctcaccaaagaagttttcaaattttgttggcccccatttgaccaaaaaagtgacactgaattccgaaaacattgctgtgaatggataaaaaggatttctggtgaatgtggaagtagctttcctcaagttgttggttcactatttctttctcctggtggtcctaagtttattcatctgatgtatcattttgcaagatttgttgcaatgaaatatattaaatccaattctaaaaattcttctcatcattttgtagagacatttaacataaaaccacaggacttgcacaaatgcattgccagatgccatttcgcacgtagcagatttttacaaattttgcaaagacaagattgtgttacccaaaaatatcaggaaaatgcacaattatcagttaagcaggtacgaaacttgagatctgaatgtataggattggaaaaccaaataaagaaaatggaaccctatgatgaccacagtaatatggaagaaaaaattcaaaaggttcggtctttgtgggcttcagtgaatgaaacgctcatgtttttggaaaaagagagagaagttgttagttcggtccttagtcttgttaaccaatatgctttagatggaactaatgttgctattaatattccaaggctcttacttgacaaaattgagaaacaaatgtttcagttgcacataggaaatgtttatgaggctggaaaactgaacctcttaacagttattcagttattaaatgaagtcttgaaggtgatgaaatatgaacgttgtcaggctgatcaagcaagattgacggtagaccttcactaccttgaaaaagagaccaaatttcagaaggaaagattatcagatctgaaacatatgaggtatagaataaaagatgatctcacaactataagacattctgttgttgaaaagcaaggagaatggcataaaaagtggaaagaatttcttggtttgtctcctttcagtctaattaaaggttggactccatctgtagatcttttaccaccaatgtctcccctttcgtttgatcctgcctcagaagaagtgtatgcaaagagtattctttgtcagtatcctgcttcacttccagatgcacataagcaacataaccaagaaaatggttgcagaggagacagtgataccttgggagcgctacatgatctagccaacagccctgcctctttcttgtcgcagtcagtttcatcatcagatagaaacagtgttacagtacttgaaaaggacacaaagatgggaactcccaaagaaaaaaatgaagcaatttctaagaaaataccagaatttgaagtggaaaattctccattatcagatgttgcaaagaatacagagagtagtgcatttggagggtctttgccagctaaaaaaagtgatccatttcaaaaagagcaagatcatctggtagaagaggttgccagagcagttttatctgattcaccacagctctctgaaggaaaagaaataaaattagaggaactaattgactctctgggttctaaccccttcttaacaaggaatcagattccccgtactccagaaaacttgataactgaaattaggagctcatggagaaaagctattgaaatggaagaaaacagaactaaagaaccaattcaaatggatgctgaacatagagaagtattgccagaatcattacctgtgttgcacaatcaaagagaatttagcatggctgattttctcttagaaaccactgtatcagattttggccagtctcatttgactgaagagaaagttatttcagattgcgagtgtgtgcctcagaaacatgtgctgaccagtcacatagatgaaccaccaacacaaaatcagtcagatttgttaaataagaaagtaatttgcaagcaagatttggaatgtttagccttcaccaagctttcagaaactagccgaatggagacattctcccctgctgtcggcaataggatagatgtgatgggtggcagtgaagaggagtttatgaaaatattggaccacttagaagtttcttgtaacaaaccttccacaaataaaactatgttgtggaattcttttcagatatcaagtggaattagttctaagagttttaaagataatgattttggcatattacacgaaactctcccggaagaagttggtcatctaagttttaatagttccagtagttcagaggccaattttaaactggagccaaatagtcctatgcatggtggcactcttctagaagatgttgtgggagggagacagactactccagaatcagactttaatttacaggctcttcgcagtagatacgaggctctgaagaaatctctttccaagaaaagggaagaatcttacctctcgaattcccaaacacccgaaagacacaaaccagaattgagccctactccccaaaatgtacaaacagatgatacgcttaactttttggacacctgtgatttgcatactgagcatataaagccatctttacgcacgtccatcggtgaaagaaaacggtctctttcaccactaattaagttttctccagtggaacaaagattgagaaccacaatagcatgtagtcttggagaactacctaatttaaaggaagaagacattttgaataagagccttgatgcaaaagaaccaccgtctgacttgacaagatgaagacgtacccatttaatataactatgatgcacttaaattgaagctatgccacaggatagaaaatgaattacaacttaaatacatgttggaagtgtaacactgtttttcaaggtttaaaaaaattcctaatgccttttagccttctttaatatttttaggtaaggaaagtatgtttggattttttcctctttgtaggtatatgagattgaaatgtgaagtatttggacaacaaacgtcaagcaatgggaagccattttgatttcttgagtaatcttgtaagcattaagtgaatgacaaagtagtagtgtaacttatttcttatgttataacttcagtcaattaatataaggatagtttttgttgtatgttcactaagtggttaatataatagccattgaatatactaatctttcatcttagagaactatacaacttttattgtttcttaatggaacattctggctaaccagaaaaagtgagaaaagtagtaccttgggatgtgtagtcaagatgacaaattttaagactggaaaagctctaaacaggcttaatgattcttcaggtagaatgatcctgagaagtgatgtttgatggaataaagtgcatgtgatgattaagtgaagactggggcagaatgatttaaaaaaaggaaaaagatggaagatgagtagacacttgcaaggaacactgtcaaactataaatccattcagtgggttgtataacatttatatttagtctaatttagactttgataatttaatgctacttttatattttaacaaaaatataaattaaaattttcattagtctgttttgttgttgggtttttttgtgaggtactccctgttgggggaaaggaacaaggaacaaccatcagaatcccccagtccctacagaatagcctcacagtaacttgagaaaactgaacttggggttaaataacttgtcacacttgcagtctcctgcctcactccttcaggtgccctgcctagaaaaagacttgtgtctagcatccaagtgaacacatactattgccctctgtgaaccaggaggaatggaacaggcaatggaagggtgatagtacctacaataccctttgtagaccccatctcactaccatcaaaatcttgtccactagcccccaaaaaactggcaaggaaagaaggtggaggggaaatttatggaagtagatggcttaatagttatttcttttatcttgggctgcctttctctaagttggttgtcctgtcccagtgtgaagacccatctttttgtgagaaaagacaaaagaaagcacatgtaactaccttctttgcaatggaaaaggagaaagaaaaaatcttctcctaagttgctgttttcttttattagttaataaaacaaatcagggactatgcaggtctatggggaaacctttagtctgctttaagaaaactcagtatctgaaaatcttaacttagcatgtgatactgtcttatcagcatctgcagaagtgccaaagccactgctagacacttaatgtgtattatttcatttaattatattttaaatgtgcttccttggtaattcttaagctcgagaaagagtttgagaactgctgctaggaaatagagattcacatttaaccctgtggtacttttaagaagcaggtacgttgttgcatatatacttgggtagagattggtaactatctgatagggaagctcaagttggccacccaagtctgagaaacccttaattactgagaatcaaaagagcagaatgtctgtagacattttggatttgtaaaaatcacattgttgagttatacctgtgatgggctgaaagtttttggcattctttcctgttcttcatatgccagtaccataaacaaaaagtatctcagatctgtcactttcttctcctaaaccaatgtgattgcagctttttgccttcagccttttccctatccagtatctcctacatagttaccttttgatcttaaggaactgttttgattgggtcacttccttgcctaaaattccattgattgttcattgttaattctaaaatagagttcaaatttaaaggcatgtaagttcccctgtaacggatttcctctactcccccttccgctgtaatctcccatttttttactgaaatgcttcagtgagcatgggtctttagaggtcttgatatacaattttcctgaagcaggaataccttgctttcctctactagtttaccacaattacagctctcttttaagcctcagaaaaaaatctcacttccgtcttgaagtcttaatccacgctttttatatccatgtgcctactccttctctgaaatctcctatggtttatctttttattcatttaatatcccacgaattgattttattatatattttttatggttgcatgtggtctttctagttatagcaatatacacatacatgcataaatacatatacacctatgtaaatgtgtgttgggagtatgtattcacacacatacatataccccaaggccatgtgtcatctttatcaatatttaagttttggaattgttttgtttgcctcctatatcatggaataaatggtaaagagggctaatttattactctaagtggatttcttattacattaatatcagacatatagaatgtactttgttttactatttgtaagatacaaaggtatataaactgacatacatcagcttgaaacctgagataatgctaaaatgttctaattattttaaatgtttaaagaggacaaccatgtaatgttgctaaacatgaaaaatgtcatcaagtggaataaagaatagctgaagttaacatttgggggaaattgagctgaaaacaaaaatatgagtattttgataccttttctttaccatgagactcttgactatgaagtcaaatttatctaaaggaaaaacaggaattctggagacctgtgtaaaagcagactattatcttcctactgtgagagtactaaaattaaaatacgtttaatgacgttttcctcaatgtaaaagcattgaagtaaatgtttcttttatgttgcagatacatagttgctctagagatcacctttttctttatgcattgtgaatagcagtctgcatcctaagtttaaaatatttgagaatcctctatgggactctctgtaaatgttttaaatactgttgttttcaataaatattttatactatctggctctggaatttcctatataatctcaaaaagaactatgcccctgcaaatcataagatgatcacatgtaaagttatattaataacctgatcaacaaatttgagaggttcagtgattcaggtcaacatattttgttacttccattttaattactagatttacagtatatagtattttaaaatgaatttttaaggttatatctatactgtcagtttacacatctggagtctttatactaatgtattgccaatggccctaattaggtaatttttataaattacacctgaatagcttcttactcttcatgagtagcgtcatccacatctgctgctagaaagggtttaatgaacattaaataattttataaagccttagaaattctaaagccctatcacttatgtttactg

SEQ ID NO: 437068 - DNA, 6086 bp, Homo sapiens
atcagaaacccgaaggcccgaggatctgggcacgacagcggttaagcaagcgcagagcaagtcgctggccgcgcaatgcccggtgggtcttgcagtttcttggctgggcatggccggaagggaggagagaaggacgcattgcatggcgggagatatagtctttgccggaagtccctcctccctcggacgcctggcggcgccggcgcacactgctcttccttaagggcgggagtctcggtttgtggtggcttcgctgaggcagtggtggccgcactataccgttagaaactcaatttcccggaggttgtgaggccctttgaggcgaaatcgctctgggcgtgaaaggagcaggcgttggcaatggaaggaccaccgcgacctcaggctgaccgtagggagggatcttgagggccctccgagtcccctgggcttgcgctttctttctttgcagccaccgtgcctaccgcgaggatgagctcggcctcggtcaccgctttcgagaaggagcatctctggatgtatctgcaggcgctcggcttcgagccaggcccggcaaccattgcctgcggaaagatcgtgtcgcacacgcacctcggagtgaacatgtttgacaagctgaaccgtgatgcctttcatataatttcttattttttgtttcaagttctggaccagtctctcaccaaagaagttttcaaattttgttggcccccatttgaccaaaaaagtgacactgaattccgaaaacattgctgtgaatggataaaaaggatttctggtgaatgtggaagtagctttcctcaagttgttggttcactatttctttctcctggtggtcctaagtttattcatctgatgtatcattttgcaagatttgttgcaatgaaatatattaaatccaattctaaaaattcttctcatcattttgtagagacatttaacataaaaccacaggacttgcacaaatgcattgccagatgccatttcgcacgtagcagatttttacaaattttgcaaagacaagattgtgttacccaaaaatatcaggaaaatgcacaattatcagttaagcaggtacgaaacttgagatctgaatgtataggattggaaaaccaaataaagaaaatggaaccctatgatgaccacagtaatatggaagaaaaaattcaaaaggttcggtctttgtgggcttcagtgaatgaaacgctcatgtttttggaaaaagagagagaagttgttagttcggtccttagtcttgttaaccaatatgctttagatggaactaatgttgctattaatattccaaggctcttacttgacaaaattgagaaacaaatgtttcagttgcacataggaaatgtttatgaggctggaaaactgaacctcttaacagttattcagttattaaatgaagtcttgaaggtgatgaaatatgaacgttgtcaggctgatcaagcaagattgacggtagaccttcactaccttgaaaaagagaccaaatttcagaaggaaagattatcagatctgaaacatatgaggtatagaataaaagatgatctcacaactataagacattctgttgttgaaaagcaaggagaatggcataaaaagtggaaagaatttcttggtttgtctcctttcagtctaattaaaggttggactccatctgtagatcttttaccaccaatgtctcccctttcgtttgatcctgcctcagaagaagtgtatgcaaagagtattctttgtcagtatcctgcttcacttccagatgcacataagcaacataaccaagaaaatggttgcagaggagacagtgataccttgggagcgctacatgatctagccaacagccctgcctctttcttgtcgcagtcagtttcatcatcagatagaaacagtgttacagtacttgaaaaggacacaaagatgggaactcccaaagaaaaaaatgaagcaatttctaagaaaataccagaatttgaagtggaaaattctccattatcagatgttgcaaagaatacagagagtagtgcatttggagggtctttgccagctaaaaaaagtgatccatttcaaaaagagcaagatcatctggtagaagaggttgccagagcagttttatctgattcaccacagctctctgaaggaaaagaaataaaattagaggaactaattgactctctgggttctaaccccttcttaacaaggaatcagattccccgtactccagaaaacttgataactgaaattaggagctcatggagaaaagctattgaaatggaagaaaacagaactaaagaaccaattcaaatggatgctgaacatagagaagtattgccagaatcattacctgtgttgcacaatcaaagagaatttagcatggctgattttctcttagaaaccactgtatcagattttggccagtctcatttgactgaagagaaagttatttcagattgcgagtgtgtgcctcagaaacatgtgctgaccagtcacatagatgaaccaccaacacaaaatcagtcagatttgttaaataagaaagtaatttgcaagcaagatttggaatgtttagccttcaccaagctttcagaaactagccgaatggagacattctcccctgctgtcggcaataggatagatgtgatgggtggcagtgaagaggagtttatgaaaatattggaccacttagaagtttcttgtaacaaaccttccacaaataaaactatgttgtggaattcttttcagatatcaagtggaattagttctaagagttttaaagataatgattttggcatattacacgaaactctcccggaagaagttggtcatctaagttttaatagttccagtagttcagaggccaattttaaactggagccaaatagtcctatgcatggtggcactcttctagaagatgttgtgggagggagacagactactccagaatcagactttaatttacaggctcttcgcagtagatacgaggctctgaagaaatctctttccaagaaaagggaagaatcttacctctcgaattcccaaacacccgaaagacacaaaccagaattgagccctactccccaaaatgtacaaacagatgatacgcttaactttttggacacctgtgatttgcatactgagcatataaagccatctttacgcacgtccatcggtgaaagaaaacggtctctttcaccactaattaagttttctccagtggaacaaagattgagaaccacaatagcatgtagtcttggagaactacctaatttaaaggaagaagacattttgaataagagccttgatgcaaaagaaccaccgtctgacttgacaagatgaagacgtacccatttaatataactatgatgcacttaaattgaagctatgccacaggatagaaaatgaattacaacttaaatacatgttggaagtgtaacactgtttttcaaggtttaaaaaaattcctaatgccttttagccttctttaatatttttaggtaaggaaagtatgtttggattttttcctctttgtaggtatatgagattgaaatgtgaagtatttggacaacaaacgtcaagcaatgggaagccattttgatttcttgagtaatcttgtaagcattaagtgaatgacaaagtagtagtgtaacttatttcttatgttataacttcagtcaattaatataaggatagtttttgttgtatgttcactaagtggttaatataatagccattgaatatactaatctttcatcttagagaactatacaacttttattgtttcttaatggaacattctggctaaccagaaaaagtgagaaaagtagtaccttgggatgtgtagtcaagatgacaaattttaagactggaaaagctctaaacaggcttaatgattcttcaggtagaatgatcctgagaagtgatgtttgatggaataaagtgcatgtgatgattaagtgaagactggggcagaatgatttaaaaaaaggaaaaagatggaagatgagtagacacttgcaaggaacactgtcaaactataaatccattcagtgggttgtataacatttatatttagtctaatttagactttgataatttaatgctacttttatattttaacaaaaatataaattaaaattttcattagtctgttttgttgttgggtttttttgtgaggtactccctgttgggggaaaggaacaaggaacaaccatcagaatcccccagtccctacagaatagcctcacagtaacttgagaaaactgaacttggggttaaataacttgtcacacttgcagtctcctgcctcactccttcaggtgccctgcctagaaaaagacttgtgtctagcatccaagtgaacacatactattgccctctgtgaaccaggaggaatggaacaggcaatggaagggtgatagtacctacaataccctttgtagaccccatctcactaccatcaaaatcttgtccactagcccccaaaaaactggcaaggaaagaaggtggaggggaaatttatggaagtagatggcttaatagttatttcttttatcttgggctgcctttctctaagttggttgtcctgtcccagtgtgaagacccatctttttgtgagaaaagacaaaagaaagcacatgtaactaccttctttgcaatggaaaaggagaaagaaaaaatcttctcctaagttgctgttttcttttattagttaataaaacaaatcagggactatgcaggtctatggggaaacctttagtctgctttaagaaaactcagtatctgaaaatcttaacttagcatgtgatactgtcttatcagcatctgcagaagtgccaaagccactgctagacacttaatgtgtattatttcatttaattatattttaaatgtgcttccttggtaattcttaagctcgagaaagagtttgagaactgctgctaggaaatagagattcacatttaaccctgtggtacttttaagaagcaggtacgttgttgcatatatacttgggtagagattggtaactatctgatagggaagctcaagttggccacccaagtctgagaaacccttaattactgagaatcaaaagagcagaatgtctgtagacattttggatttgtaaaaatcacattgttgagttatacctgtgatgggctgaaagtttttggcattctttcctgttcttcatatgccagtaccataaacaaaaagtatctcagatctgtcactttcttctcctaaaccaatgtgattgcagctttttgccttcagccttttccctatccagtatctcctacatagttaccttttgatcttaaggaactgttttgattgggtcacttccttgcctaaaattccattgattgttcattgttaattctaaaatagagttcaaatttaaaggcatgtaagttcccctgtaacggatttcctctactcccccttccgctgtaatctcccatttttttactgaaatgcttcagtgagcatgggtctttagaggtcttgatatacaattttcctgaagcaggaataccttgctttcctctactagtttaccacaattacagctctcttttaagcctcagaaaaaaatctcacttccgtcttgaagtcttaatccacgctttttatatccatgtgcctactccttctctgaaatctcctatggtttatctttttattcatttaatatcccacgaattgattttattatatattttttatggttgcatgtggtctttctagttatagcaatatacacatacatgcataaatacatatacacctatgtaaatgtgtgttgggagtatgtattcacacacatacatataccccaaggccatgtgtcatctttatcaatatttaagttttggaattgttttgtttgcctcctatatcatggaataaatggtaaagagggtcaaaaaaaaaaaaaaaggaaaaaaaaatttttggggggcgggctcgagaaaggtttaaaaccattgtgggggggcggccagaaggttatgaaagggcaaagggttccaggaacgggcagaaagggtggttcacaaaaaaagcgggacggggttgaa

SEQ ID NO: 437069 - DNA, 4768 bp, Homo sapiens
aagcagggtatcaacgcagagtggtcattatggccggggtactccagaaaactcgataactgaaattaggagctcatggagaaaagctattgaaatggaagaaaacagaactaaagaaccaattcaaatggatgctgaacatagagaagtattgccagaatcattacctgtgttgcacaatcaaagagaatttagcatggctgattttctcttagaaaccactgtatcagattttggccagtctcatttgactgaagagaaagttatttcagattgcgagtgtgtgcctcagaaacatgtgctgaccagtcacatagatgaaccaccaacacaaaatcagtcagatttgttaaataagaaagtaatttgcaagcaagatttggaatgtttagccttcaccaagctttcagaaactagccgaatggagacattctcccctgctgtcggcaataggatagatgtgatgggtggcagtgaagaggagtttatgaaaatattggaccacttagaagtttcttgtaacaaaccttccacaaataaaactatgttgtggaattcttttcagatatcaagtggaattagttctaagagttttaaagataatgattttggcatattacacgaaactctcccggaagaagttggtcatctaagttttaatagttccagtagttcagaggccaattttaaactggagccaaatagtcctatgcatggtggcactcttctagaagatgttgtgggagggagacagactactccagaatcagactttaatttacaggctcttcgcagtagatacgaggctctgaagaaatctctttccaagaaaagggaagaatcttacctctcgaattcccaaacacccgaaagacacaaaccagaattgagccctactccccaaaatgtacaaacagatgatacgcttaactttttggacacctgtgatttgcatactgagcatataaagccatctttacgcacgtccatcggtgaaagaaaacggtctctttcaccactaattaagttttctccagtggaacaaagattgagaaccacaatagcatgtagtcttggagaactacctaatttaaaggaagaagacattttgaataagagccttgatgcaaaagaaccaccgtctgacttgacaagatgaagacgtacccatttaatataactatgatgcacttaaattgaagctatgccacaggatagaaaatgaattacaacttaaatacatgttggaagtgtaacactgtttttcaaggtttaaaaaaattcctaatgccttttagccttctttaatatttttaggtaaggaaagtatgtttggattttttcctctttgtaggtatatgagattgaaatgtgaagtatttggacaacaaacgtcaagcaatgggaagccattttgatttcttgagtaatcttgtaagcattaagtgaatgacaaagtagtagtgtaacttatttcttatgttataacttcagtcaattaatataaggatagtttttgttgtatgttcactaagtggttaatataatagccattgaatatactaatctttcatcttagagaactatacaacttttattgtttcttaatggaacattctggctaaccagaaaaagtgagaaaagtagtaccttgggatgtgtagtcaagatgacaaattttaagactggaaaagctctaaacaggcttaatgattcttcaggtagaatgatcctgagaagtgatgtttgatggaataaagtgcatgtgatgattaagtgaagactggggcagaatgatttaaaaaaaggaaaaagatggaagatgagtagacacttgcaaggaacactgtcaaactataaatccattcagtgggttgtataacatttatatttagtctaatttagactttgataatttaatgctacttttatattttaacaaaaatataaattaaaattttcattagtctgttttgttgttgggtttttttgtgaggtactccctgttgggggaaaggaacaaggaacaaccatcagaatcccccagtccctacagaatagcctcacagtaacttgagaaaactgaacttggggttaaataacttgtcacacttgcagtctcctgcctcactccttcaggtgccctgcctagaaaaagacttgtgtctagcatccaagtgaacacatactattgccctctgtgaaccaggaggaatggaacaggcaatggaagggtgatagtacctacaataccctttgtagaccccatctcactaccatcaaaatcttgtccactagcccccaaaaaactggcaaggaaagaaggtggaggggaaatttatggaagtagatggcttaatagttatttcttttatcttgggctgcctttctctaagttggttgtcctgtcccagtgtgaagacccatctttttgtgagaaaagacaaaagaaagcacatgtaactaccttctttgcaatggaaaaggagaaagaaaaaatcttctcctaagttgctgttttcttttattagttaataaaacaaatcagggactatgcaggtctatggggaaacctttagtctgctttaagaaaactcagtatctgaaaatcttaacttagcatgtgatactgtcttatcagcatctgcagaagtgccaaagccactgctagacacttaatgtgtattatttcatttaattatattttaaatgtgcttccttggtaattcttaagctcgagaaagagtttgagaactgctgctaggaaatagagattcacatttaaccctgtggtacttttaagaagcaggtacgttgttgcatatatacttgggtagagattggtaactatctgatagggaagctcaagttggccacccaagtctgagaaacccttaattactgagaatcaaaagagcagaatgtctgtagacattttggatttgtaaaaatcacattgttgagttatacctgtgatgggctgaaagtttttggcattctttcctgttcttcatatgccagtaccataaacaaaaagtatctcagatctgtcactttcttctcctaaaccaatgtgattgcagctttttgccttcagccttttccctatccagtatctcctacatagttaccttttgatcttaaggaactgttttgattgggtcacttccttgcctaaaattccattgattgttcattgttaattctaaaatagagttcaaatttaaaggcatgtaagttcccctgtaacggatttcctctactcccccttccgctgtaatctcccatttttttactgaaatgcttcagtgagcatgggtctttagaggtcttgatatacaattttcctgaagcaggaataccttgctttcctctactagtttaccacaattacagctctcttttaagcctcagaaaaaaatctcacttccgtcttgaagtcttaatccacgctttttatatccatgtgcctactccttctctgaaatctcctatggtttatctttttattcatttaatatcccacgaattgattttattatatattttttatggttgcatgtggtctttctagttatagcaatatacacatacatgcataaatacatatacacctatgtaaatgtgtgttgggagtatgtattcacacacatacatataccccaaggccatgtgtcatctttatcaatatttaagttttggaattgttttgtttgcctcctatatcatggaataaatggtaaagagggctaatttattactctaagtggatttcttattacattaatatcagacatatagaatgtactttgttttactatttgtaagatacaaaggtatataaactgacatacatcagcttgaaacctgagataatgctaaaatgttctaattattttaaatgtttaaagaggacaaccatgtaatgttgctaaacatgaaaaatgtcatcaagtggaataaagaatagctgaagttaacatttgggggaaattgagctgaaaacaaaaatatgagtattttgataccttttctttaccatgagactcttgactatgaagtcaaatttatctaaaggaaaaacaggaattctggagacctgtgtaaaagcagactattatcttcctactgtgagagtactaaaattaaaatacgtttaatgacgttttcctcaatgtaaaagcattgaagtaaatgtttcttttatgttgcagatacatagttgctctagagatcacctttttctttatgcattgtgaatagcagtctgcatcctaagtttaaaatatttgagaatcctctatgggactctctgtaaatgttttaaatactgttgttttcaataaatattttatactatctggctctggaatttcctatataatctcaaaaagaactatgcccctgcaaatcataagatgatcacatgtaaagttatattaataacctgatcaacaaatttgagaggttcagtgattcaggtcaacatattttgttacttccattttaattactagatttacagtatatagtattttaaaatgaatttttaaggttatatctatactgtcagtttacacatctggagtctttatactaatgtattgccaatggccctaattaggtaatttttataaattacacctgaatagcttcttactcttcatgagtagcgtcatccacatctgctgctagaaagggtttaatgaacattaaataattttataaagccttagaaattctaaagccctatcacttatgtttactg

SEQ ID NO: 437070 - DNA, 1203 bp, Homo sapiens
gagtttgcatattgtattttagtttgcattcctttcacagacaatttaagggattttcaattaaatttctaaattttaattgaattccttaattttaattgtgggaactttcctggatccaaacaacagacgttgaccctcctagtgagatcccaggtcacaaaccgtggagcggctccagcctgactggcaagtgtggcttgcaaaacgcggaaaaccgagacacgcccagagataggaggagggaagtgcaggccccgtccaataagtattcaggccccgcccgccacgtcgctggccacgccccggcccggcctctccgttcgcgcgcagccgcctgcagacccggaagtggatggcgtggagatatggcgcaactgcggcgcgtgagttttcctttgtttagattaagtgttcgcttagcggtgccctcacgcttctgtacccgggatgtggggggcggtacagaccttgaaatccccgcaccgctctctccaccccgagtaaattcatgcgtcccgtcagagtgttaaaatcgccctagggctggttctgtctccggtcgttctgccgtagggctgcgtaggcagctgctttcgcgccgttttcctgcttaaaacccttcagtgacccctccgccagccccgcgccacgtaaagtccccgcctgcgaggcggatccacgccctccgggtcccaagcctcgtccttgtcggcccctggggcgcagcgccgcagccgccattcgggaggggccgcgtcctctgcctggtctggggattctgcagaccccacccctgatctgcctgccgccgtagtcctccttgggccgttcccttctgtccccaggccttttcgcagtcacggcttctccggatcctgtgttgggggaggtggccgggacctatctcagggcacccagtgttcttccgtcccaaattcctcccattggaaactgtgctcttgaggaggtgggtattttattccagtcccctccctgtgaatgtgaagtgaaagagagatggagagcgaggtagaggaaacagaaaaatttagagagaaaataatgaggaagatccataacaagacggcaacgcagagggagggtgagagatttgcaaagtgaaagaagcaccccaggaagtagcagggagagaaaagcaactcgagaaatgtagagaaaagttctatttctagacagatg

SEQ ID NO: 437071 - DNA, 2969 bp, Homo sapiens
ggctgggtgtgaatcggccgagggagatatggcgcaactgcggcgcggacacttgacattcagggacgtggccatagaattctctcaggaggagtggaaatgcctggaccctgtgcagaaggctttatacagggatgtgatgttggagaactacaggaacctggtctccctgggaatctgtcttcctgacctgagtattatctccatgatgaagcaaaggacagagccctggactgtggagaatgaaatgaaagtagcaaaaaatccagataggtgggaaggtatcaaagatatcaacacagggaggagctgtgcagtgagaagcaaagcaggaaacaagcctattacaaatcaacttggattaacctttcagttacctctgccagaactggagatatttcaaggtgaagggaagatttatgaatgtaatcaagttcaaaagttcatcagccacagttcttcagtttcgccacttcaaagaatttactctggggtcaaaacccacatatttaataaacataggaatgattttgttgattttccattgctgtcacaagaacagaaagcacacattaggagaaaaccttacgaatgtaatgagcagggcaaagtcttcagagtgtcttcaagccttcctaatcatcaagtaatccacactgcagataaacctaacagatgtcatgaatgtggtaaaaccgtcagggacaagtcaggcctcgcagaacattggagaattcgtacaggagagaaaccttacaaatgtaaagagtgtggcaagctcttcaatcgaattgcataccttgcacgacacgagaaagtgcatactggagagagtccttacaaatgtaatgagtgtggcaaggtcttcagtcgaattacataccttgtacgacatcagaaaattcatactagagagaaacctcataaatgtaacaaatgtggcaaggtttatagtagcagttcatacctagcacaacattggagaattcatacaggagagaaactttacaaatgtaataaatgtggcaaagaatttagtgggcattcaagcctcaccacccatctgttaatccacactggagagaaaccttacaaatgtaaagaatgtgacaaagcttttaggcacaagttctccctgacagttcatcagagaaatcataatggagagaaaccttataaatgtcatgaatgtggcaaagtcttcactcaagtttcacatcttgcacgacatcagaaaattcacactggagagaaaccttacaaatgtaatgagtgtggcaaagtcttcactcagaattcacaccttgcaaatcatcagagaatccacactggagagaaaccttacaaatgccatgtgtgtggtaaggtctttaggcacagttcatggtttgtacagcatcagagaagtgttcatgagagagtccttacaaactgagtttggcaaactctatcataagttctagcagtaatcaacatccgagagtctatactagaaagaaatcatttaaatgtactatatgtggcacaggctgtatcgagacctaccaaatcactagacatcgaaacattcatctttggtgaaaccacacaaatggattgtgtgtgccaaggccaacaagtcaaaatatgttgaacctaatgatatgatgtgtataaagggtgcaaggacacgtggaaatgatctgtaatattcgggttattaaaaatgtaattggctgggcgcagtggctcacacctgtaatcctagcactttgggaggttgaggcaggtggatcacaaggtcaggagtttgagaccagcctggccaatatggtgaaacaccatatctactataaatacaaaaaaattagccaggcgtggtggcacatgcctgcaatcccagctactcgggaggctgaggcaggagaattgcttgaatccaggaggcagaggttgttgcagtgagctgagatcgcgccactgcactccaacctgggtgacagagcgagactccgtctcaaaaaaaaaaaaaaattatttgggtttgaaaggccaggggcagtggttcatgcctataatctcagcacaatagaaagccaagacaggagggtcacttgatgcctggagatcaagataagtatgggcaacgtagcaaggcccatccctacaaaataaaaaaaataagccaggcccttggcatgtgtctgtagttccagctactcaagaggccgaggcaagaggattgctcaagcccaggagtttgagagtttgagcagtgagctctgatcttgccatttgtactccagcttgggtgacagagcgagaccctgtctcaaaagaaaaaaaaggctagtttttatgacttcaacctgaactttgaaatttcttcatgtgccttccctacaggcctttcactgtggtctgggaaagaatcagtaagatgacagggctgacttcattagatgaggagcgtttctatccagtttcctggaggaataaggacactgccttttcagattaaagattgtctgatttagagaccatggaggtggacagagaataacaaaaccgtgatggcagtcatcatgcttattgcagttagcacacacttttcctgacaggcacagtgctgctgtgctctacaaatgaccatgaaatagagcacgccatgactttaggacacagggatttttatgggaagagagttcatcagggactgattacgtaggagagacgatgcaggggaaatggtggccaccgtctccattgaatagcaatagctgctgtttagcaaagactgattaaaaagtactctgatttttcaaatggaagagagaacagttaaatcagagtagagagtttaatcaaaactaccagtggaacatgttcttgagtaggattcacatttaactgctggcataatttgcaactgttggattttctcatgtttggaacaataaagttgaaattttccaaagtgtgaatgattt

SEQ ID NO: 437072 - DNA, 3056 bp, Homo sapiens
  misc_feature (59)..(59): n is a, c, g, or t
tccttatactataatctgtaacgaaaatacatacaaagttgaaaaacaggacttctcgnggacacttgacattcagggacgtggccatagaattctctcaggaggagtggaaatgcctggaccctgtgcagaaggctttatacagggatgtgatgttggagaactacaggaacctggtctccctgggaatctgtcttcctgacctgagtattatctccatgatgaagcaaaggacagagccctggactgtggagaatgaaatgaaagtagcaaaaaatccagataggtgggaaggtatcaaagatatcaacacagatggagtcctgttctgtcgcccaggctggagtacagtggtgtgatctcggctcactgcaacttccgcctcccagggaggagctgtgcagtgagaagcaaagcaggaaacaagcctattacaaatcaacttggattaacctttcagttacctctgccagaactggagatatttcaaggtgaagggaagatttatgaatgtaatcaagttcaaaagttcatcagccacagttcttcagtttcgccacttcaaagaatttactctggggtcaaaacccacatatttaataaacataggaatgattttgttgattttccattgctgtcacaagaacagaaagcacacattaggagaaaaccttacgaatgtaatgagcagggcaaagtcttcagagtgtcttcaagccttcctaatcatcaagtaatccacactgcagataaacctaacagatgtcatgaatgtggtaaaaccgtcagggacaagtcaggcctcgcagaacattggagaattcgtacaggagagaaaccttacaaatgtaaagagtgtggcaagctcttcaatcgaattgcataccttgcacgacacgagaaagtgcatactggagagagtccttacaaatgtaatgagtgtggcaaggtcttcagtcgaattacataccttgtacgacatcagaaaattcatactagagagaaacctcataaatgtaacaaatgtggcaaggtttatagtagcagttcatacctagcacaacattggagaattcatacaggagagaaactttacaaatgtaataaatgtggcaaagaatttagtgggcattcaagcctcaccacccatctgttaatccacactggagagaaaccttacaaatgtaaagaatgtgacaaagcttttaggcacaagttctccctgacagttcatcagagaaatcataatggagagaaaccttataaatgtcatgaatgtggcaaagtcttcactcaagtttcacatcttgcacgacatcagaaaattcacactggagagaaaccttacaaatgtaatgagtgtggcaaagtcttcactcagaattcacaccttgcaaatcatcagagaatccacactggagagaaaccttacaaatgccatgtgtgtggtaaggtctttaggcacagttcatggtttgtacagcatcagagaagtgttcatgagagagtccttacaaactgagtttggcaaactctatcataagttctagcagtaatcaacatccgagagtctatactagaaagaaatcatttaaatgtactatatgtggcacaggctgtatcgagacctaccaaatcactagacatcgaaacattcatctttggtgaaaccacacaaatggattgtgtgtgccaaggccaacaagtcaaaatatgttgaacctaatgatatgatgtgtataaagggtgcaaggacacgtggaaatgatctgtaatattcgggttattaaaaatgtaattggctgggcgcagtggctcacacctgtaatcctagcactttgggaggttgaggcaggtggatcacaaggtcaggagtttgagaccagcctggccaatatggtgaaacaccatatctactataaatacaaaaaaattagccaggcgtggtggcacatgcctgcaatcccagctactcgggaggctgaggcaggagaattgcttgaatccaggaggcagaggttgttgcagtgagctgagatcgcgccactgcactccaacctgggtgacagagcgagactccgtctcaaaaaaaaaaaaaaattatttgggtttgaaaggccaggggcagtggttcatgcctataatctcagcacaatagaaagccaagacaggagggtcacttgatgcctggagatcaagataagtatgggcaacgtagcaaggcccatccctacaaaataaaaaaaataagccaggcccttggcatgtgtctgtagttccagctactcaagaggccgaggcaagaggattgctcaagcccaggagtttgagagtttgagcagtgagctctgatcttgccatttgtactccagcttgggtgacagagcgagaccctgtctcaaaagaaaaaaaaggctagtttttatgacttcaacctgaactttgaaatttcttcatgtgccttccctacaggcctttcactgtggtctgggaaagaatcagtaagatgacagggctgacttcattagatgaggagcgtttctatccagtttcctggaggaataaggacactgccttttcagattaaagattgtctgatttagagaccatggaggtggacagagaataacaaaaccgtgatggcagtcatcatgcttattgcagttagcacacacttttcctgacaggcacagtgctgctgtgctctacaaatgaccatgaaatagagcacgccatgactttaggacacagggatttttatgggaagagagttcatcagggactgattacgtaggagagacgatgcaggggaaatggtggccaccgtctccattgaatagcaatagctgctgtttagcaaagactgattaaaaagtactctgatttttcaaatggaagagagaacagttaaatcagagtagagagtttaatcaaaactaccagtggaacatgttcttgagtaggattcacatttaactgctggcataatttgcaactgttggattttctcatgtttggaacaataaagttgaaattttccaaagtgtgaatgattt

SEQ ID NO: 437073 - DNA, 667 bp, Homo sapiens
  misc_feature (31)..(32): n is a, c, g, or t
tgatctagaggatcccaagtaccacctgcanngtacccacctgcaactgaactttgaaatttcttcatgtgccttccctacaggcctttcactgtggtctgggaaagaatcagtaagatgacagggctgacttcattagatgaggagcgtttctatccagtttcctggaggaataaggacactgccttttcagattaaagattgtctgatttagagaccatggaggtggacagagaataacaaaaccgtgatggcagtcatcatgcttattgcagttagcacacacttttcctgacaggcacagtgctgctgtgctctacaaatgaccatgaaatagagcacgccatgactttaggacacagggatttttatgggaagagagttcatcagggactgattacgtaggagagacgatgcaggggaaatggtggccaccgtctccattgaatagcaatagctgctgtttagcaaagactgattaaaaagtactctgatttttcaaatggaagagagaacagttaaatcagagtagagagtttaatcaaaactaccagtggaacatgttcttgagtaggattcacatttaactgctggcataatttgcaactgttggattttctcatgtttggaacaataaagttgaaattttccaaagtgtgaatgattt

SEQ ID NO: 437074 - DNA, 683 bp, Homo sapiens
gagtttgcatattgtattttagtttgcattcctttcacagacaatttaagggattttcaattaaatttctaaattttaattgaattccttaattttaattgtgggaactttcctggatccaaacaacagacgttgaccctcctagtgagatcccaggtcacaaaccgtggagcggctccagcctgactggcaagtgtggcttgcaaaacgcggaaaaccgagacacgcccagagataggaggagggaagtgcaggccccgtccaataagtattcaggccccgcccgccacgtcgctggccacgccccggcccggcctctccgttcgcgcgcagccgcctgcagacccggaagtggatggcgtggagatatggcgcaactgcggcgcggacacttgacattcagggacgtggccatagaattctctcaggaggagtggaaatgcctggaccctgtgcagaaggctttatacagggatgtgatgttggagaactacaggaacctggtctccctgggaatctgtcttcctgacctgagtattatctccatgatgaagcaaaggacagagccctggactgtggagaatgaaatgaaagtagcaaaaaatcccgcatcttgctcccatcaggactctgtttttataacctacagaggtcaatgtatagaaatccgtctgatgggaact

SEQ ID NO: 437075 - DNA, 3383 bp, Homo sapiens
gagtttgcatattgtattttagtttgcattcctttcacagacaatttaagggattttcaattaaatttctaaattttaattgaattccttaattttaattgtgggaactttcctggatccaaacaacagacgttgaccctcctagtgagatcccaggtcacaaaccgtggagcggctccagcctgactggcaagtgtggcttgcaaaacgcggaaaaccgagacacgcccagagataggaggagggaagtgcaggccccgtccaataagtattcaggccccgcccgccacgtcgctggccacgccccggcccggcctctccgttcgcgcgcagccgcctgcagacccggaagtggatggcgtggagatatggcgcaactgcggcgcggacacttgacattcagggacgtggccatagaattctctcaggaggagtggaaatgcctggaccctgtgcagaaggctttatacagggatgtgatgttggagaactacaggaacctggtctccctgggaatctgtcttcctgacctgagtattatctccatgatgaagcaaaggacagagccctggactgtggagaatgaaatgaaagtagcaaaaaatccagataggtgggaaggtatcaaagatatcaacacagatggagtcctgttctgtcgcccaggctggagtacagtggtgtgatctcggctcactgcaacttccgcctcccagggaggagctgtgcagtgagaagcaaagcaggaaacaagcctattacaaatcaacttggattaacctttcagttacctctgccagaactggagatatttcaaggtgaagggaagatttatgaatgtaatcaagttcaaaagttcatcagccacagttcttcagtttcgccacttcaaagaatttactctggggtcaaaacccacatatttaataaacataggaatgattttgttgattttccattgctgtcacaagaacagaaagcacacattaggagaaaaccttacgaatgtaatgagcagggcaaagtcttcagagtgtcttcaagccttcctaatcatcaagtaatccacactgcagataaacctaacagatgtcatgaatgtggtaaaaccgtcagggacaagtcaggcctcgcagaacattggagaattcgtacaggagagaaaccttacaaatgtaaagagtgtggcaagctcttcaatcgaattgcataccttgcacgacacgagaaagtgcatactggagagagtccttacaaatgtaatgagtgtggcaaggtcttcagtcgaattacataccttgtacgacatcagaaaattcatactagagagaaacctcataaatgtaacaaatgtggcaaggtttatagtagcagttcatacctagcacaacattggagaattcatacaggagagaaactttacaaatgtaataaatgtggcaaagaatttagtgggcattcaagcctcaccacccatctgttaatccacactggagagaaaccttacaaatgtaaagaatgtgacaaagcttttaggcacaagttctccctgacagttcatcagagaaatcataatggagagaaaccttataaatgtcatgaatgtggcaaagtcttcactcaagtttcacatcttgcacgacatcagaaaattcacactggagagaaaccttacaaatgtaatgagtgtggcaaagtcttcactcagaattcacaccttgcaaatcatcagagaatccacactggagagaaaccttacaaatgccatgtgtgtggtaaggtctttaggcacagttcatggtttgtacagcatcagagaagtgttcatgagagagtccttacaaactgagtttggcaaactctatcataagttctagcagtaatcaacatccgagagtctatactagaaagaaatcatttaaatgtactatatgtggcacaggctgtatcgagacctaccaaatcactagacatcgaaacattcatctttggtgaaaccacacaaatggattgtgtgtgccaaggccaacaagtcaaaatatgttgaacctaatgatatgatgtgtataaagggtgcaaggacacgtggaaatgatctgtaatattcgggttattaaaaatgtaattggctgggcgcagtggctcacacctgtaatcctagcactttgggaggttgaggcaggtggatcacaaggtcaggagtttgagaccagcctggccaatatggtgaaacaccatatctactataaatacaaaaaaattagccaggcgtggtggcacatgcctgcaatcccagctactcgggaggctgaggcaggagaattgcttgaatccaggaggcagaggttgttgcagtgagctgagatcgcgccactgcactccaacctgggtgacagagcgagactccgtctcaaaaaaaaaaaaaaattatttgggtttgaaaggccaggggcagtggttcatgcctataatctcagcacaatagaaagccaagacaggagggtcacttgatgcctggagatcaagataagtatgggcaacgtagcaaggcccatccctacaaaataaaaaaaataagccaggcccttggcatgtgtctgtagttccagctactcaagaggccgaggcaagaggattgctcaagcccaggagtttgagagtttgagcagtgagctctgatcttgccatttgtactccagcttgggtgacagagcgagaccctgtctcaaaagaaaaaaaaggctagtttttatgacttcaacctgaactttgaaatttcttcatgtgccttccctacaggcctttcactgtggtctgggaaagaatcagtaagatgacagggctgacttcattagatgaggagcgtttctatccagtttcctggaggaataaggacactgccttttcagattaaagattgtctgatttagagaccatggaggtggacagagaataacaaaaccgtgatggcagtcatcatgcttattgcagttagcacacacttttcctgacaggcacagtgctgctgtgctctacaaatgaccatgaaatagagcacgccatgactttaggacacagggatttttatgggaagagagttcatcagggactgattacgtaggagagacgatgcaggggaaatggtggccaccgtctccattgaatagcaatagctgctgtttagcaaagactgattaaaaagtactctgatttttcaaatggaagagagaacagttaaatcagagtagagagtttaatcaaaactaccagtggaacatgttcttgagtaggattcacatttaactgctggcataatttgcaactgttggattttctcatgtttggaacaataaagttgaaattttccaaagtgtgaatgattt

SEQ ID NO: 437076 - DNA, 2729 bp, Homo sapiens
aaaaaaataatggcattatttgggccacttggaaaacccggtggtattccatgaagaaaaccactatgaagataatcccattcaccagactcacaattggagaaggacagcaacaccacctggggggagccaaacaggctggagacagaaactcccggtgtggcagctgagatggcccaggaaagaactatattaccttcaaaaagagaggtacatgcgatgtttgaggtggcatgaagctcagtggtgttatattggaatgagtgagtgaccatcctggagccttcctgaaagaggattggaacatcagttaacatctgaccactgccagcccaccccctcccacccacgtcgattgcatctctgggctccagggataaagcaggtcttggggtgcaccatgatttcaccattcttagtactggccattggcacctgccttactaactccttagtgccagagaaagagaaagaccccaagtactggcgagaccaagcgcaagagacactgaaatatgccctggagcttcagaagctcaacaccaacgtggctaagaatgtcatcatgttcctgggagatgggatgggtgtctccacagtgacggctgcccgcatcctcaagggtcagctccaccacaaccctggggaggagaccaggctggagatggacaagttccccttcgtggccctctccaagacgtacaacaccaatgcccaggtccctgacagcgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagcactcccacttcatctggaaccgcacggaactcctgacccttgacccccacaatgtggactacctattgggtctcttcgagccaggggacatgcagtacgagctgaacaggaacaacgtgacggacccgtcactctccgagatggtggtggtggccatccagatcctgcggaagaaccccaaaggcttcttcttgctggtggaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaggaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatt

SEQ ID NO: 437077 - DNA, 2446 bp, Homo sapiens
cctcactcgggccccgcggccgcctttataaggcggcgggggtggtggcccgggccgcgttgcgctcccgccactccgcgcccgctatcctggctccgtgctcccacgcgcttgtgcctggacggaccctcgccagtgctctgcgcaggattggaacatcagttaacatctgaccactgccagcccaccccctcccacccacgtcgattgcatctctgggctccagggataaagcaggtcttggggtgcaccatgatttcaccattcttagtactggccattggcacctgccttactaactccttagtgccagagaaagagaaagaccccaagtactggcgagaccaagcgcaagagacactgaaatatgccctggagcttcagaagctcaacaccaacgtggctaagaatgtcatcatgttcctgggagatgggatgggtgtctccacagtgacggctgcccgcatcctcaagggtcagctccaccacaaccctggggaggagaccaggctggagatggacaagttccccttcgtggccctctccaagacgtacaacaccaatgcccaggtccctgacagcgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagcactcccacttcatctggaaccgcacggaactcctgacccttgacccccacaatgtggactacctattgggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaggaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatt

SEQ ID NO: 437078 - DNA, 2416 bp, Homo sapiens
cctcactcgggccccgcggccgcctttataaggcggcgggggtggtggcccgggccgcgttgcgctcccgccactccgcgcccgctatcctggctccgtgctcccacgcgcttgtgcctggacggaccctcgccagtgctctgcgcagagaaagagaaagaccccaagtactggcgagaccaagcgcaagagacactgaaatatgccctggagcttcagaagctcaacaccaacgtggctaagaatgtcatcatgttcctgggagatgggatgggtgtctccacagtgacggctgcccgcatcctcaagggtcagctccaccacaaccctggggaggagaccaggctggagatggacaagttccccttcgtggccctctccaagacgtacaacaccaatgcccaggtccctgacagcgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagcactcccacttcatctggaaccgcacggaactcctgacccttgacccccacaatgtggactacctattgggtctcttcgagccaggggacatgcagtacgagctgaacaggaacaacgtgacggacccgtcactctccgagatggtggtggtggccatccagatcctgcggaagaaccccaaaggcttcttcttgctggtggaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaggaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatt

SEQ ID NO: 437079 - DNA, 1593 bp, Homo sapiens
cctcactcgggccccgcggccgcctttataaggcggcgggggtggtggcccgggccgcgttgcgctcccgccactccgcgcccgctatcctggctccgtgctcccacgcgcttgtgcctggacggaccctcgccagtgctctgcgcaggattggaacatcagttaacatctgaccactgccagcccaccccctcccacccacgtcgattgcatctctgggctccagggataaagcaggtcttggggtgcaccatgatttcaccattcttagtactggccattggcacctgccttactaactccttagtgccagagaaagagaaagaccccaagtactggcgagaccaagcgcaagagacactgaaatatgccctggagcttcagaagctcaacaccaacgtggctaagaatgtcatcatgttcctgggagatgggatgggtgtctccacagtgacggctgcccgcatcctcaagggtcagctccaccacaaccctggggaggagaccaggctggagatggacaagttccccttcgtggccctctccaagacgtacaacaccaatgcccaggtccctgacagcgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagtgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatt

SEQ ID NO: 437080 - DNA, 2602 bp, Homo sapiens
cctcactcgggccccgcggccgcctttataaggcggcgggggtggtggcccgggccgcgttgcgctcccgccactccgcgcccgctatcctggctccgtgctcccacgcgcttgtgcctggacggaccctcgccagtgctctgcgcaggattggaacatcagttaacatctgaccactgccagcccaccccctcccacccacgtcgattgcatctctgggctccagggataaagcaggtcttggggtgcaccatgatttcaccattcttagtactggccattggcacctgccttactaactccttagtgccagagaaagagaaagaccccaagtactggcgagaccaagcgcaagagacactgaaatatgccctggagcttcagaagctcaacaccaacgtggctaagaatgtcatcatgttcctgggagatgggatgggtgtctccacagtgacggctgcccgcatcctcaagggtcagctccaccacaaccctggggaggagaccaggctggagatggacaagttccccttcgtggccctctccaagacgtacaacaccaatgcccaggtccctgacagcgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagcactcccacttcatctggaaccgcacggaactcctgacccttgacccccacaatgtggactacctattgggtctcttcgagccaggggacatgcagtacgagctgaacaggaacaacgtgacggacccgtcactctccgagatggtggtggtggccatccagatcctgcggaagaaccccaaaggcttcttcttgctggtggaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaggaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatttccgaggacaaaaaaaagtct

SEQ ID NO: 437081 - DNA, 2574 bp, Homo sapiens
  misc_feature (2570)..(2570): n is a, c, g, or t
cctcactcgggccccgcggccgcctttataaggcggcgggggtggtggcccgggccgcgttgcgctcccgccactccgcgcccgctatcctggctccgtgctcccacgcgcttgtgcctggacggaccctcgccagtgctctgcgcaggattggaacatcagttaacatctgaccactgccagcccaccccctcccacccacgtcgattgcatctctgggctccagggataaagcaggtcttggggtgcaccatgatttcaccattcttagtactggccattggcacctgccttactaactccttagtgccagagaaagagaaagaccccaagtactggcgagaccaagcgcaagagacactgaaatatgccctggagcttcagaagctcaacaccaacgtggctaagaatgtcatcatgttcctgggagatgggatgggtgtctccacagtgacggctgcccgcatcctcaagggtcagctccaccacaaccctggggaggagaccaggctggagatggacaagttccccttcgtggccctctccaagacgtacaacaccaatgcccaggtccctgacagcgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagcactcccacttcatctggaaccgcacggaactcctgacccttgacccccacaatgtggactacctattgggtctcttcgagccaggggacatgcagtacgagctgaacaggaacaacgtgacggacccgtcactctccgagatggtggtggtggccatccagatcctgcggaagaaccccaaaggcttcttcttgctggtggaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaggaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttccggccggcgcgctggccggactcgagacgncgct

SEQ ID NO: 437082 - DNA, 2581 bp, Homo sapiens
cctcactcgggccccgcggccgcctttataaggcggcgggggtggtggcccgggccgcgttgcgctcccgccactccgcgcccgctatcctggctccgtgctcccacgcgcttgtgcctggacggaccctcgccagtgctctgcgcaggattggaacatcagttaacatctgaccactgccagcccaccccctcccacccacgtcgattgcatctctgggctccagggataaagcaggtcttggggtgcaccatgatttcaccattcttagtactggccattggcacctgccttactaactccttagtgccagagaaagagaaagaccccaagtactggcgagaccaagcgcaagagacactgaaatatgccctggagcttcagaagctcaacaccaacgtggctaagaatgtcatcatgttcctgggagatgggatgggtgtctccacagtgacggctgcccgcatcctcaagggtcagctccaccacaaccctggggaggagaccaggctggagatggacaagttccccttcgtggccctctccaagacgtacaacaccaatgcccaggtccctgacagcgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagcactcccacttcatctggaaccgcacggaactcctgacccttgacccccacaatgtggactacctattgggtctcttcgagccaggggacatgcagtacgagctgaacaggaacaacgtgacggacccgtcactctccgagatggtggtggtggccatccagatcctgcggaagaaccccaaaggcttcttcttgctggtggaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaggaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatt

SEQ ID NO: 437083 - DNA, 2947 bp, Homo sapiens
cctcactcgggccccgcggccgcctttataaggcggcgggggtggtggcccgggccgcgttgcgctcccgccactccgcgcccgctatcctggctccgtgctcccacgcgcttgtgcctggacggaccctcgccagtgctctgcgcaggattggaacatcagttaacatctgaccactgccagcccaccccctcccacccacgtcgattgcatctctgggctccagggataaagcaggtcttggggtgcaccatgatttcaccattcttagtactggccattggcacctgccttactaactccttagtgccagagaaagagaaagaccccaagtactggcgagaccaagcgcaagagacactgaaatatgccctggagcttcagaagctcaacaccaacgtggctaagaatgtcatcatgttcctgggagatgggatgggtgtctccacagtgacggctgcccgcatcctcaagggtcagctccaccacaaccctggggaggagaccaggctggagatggacaagttccccttcgtggccctctccaagacgtacaacaccaatgcccaggtccctgacagcgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagcactcccacttcatctggaaccgcacggaactcctgacccttgacccccacaatgtggactacctattgggtctcttcgagccaggggacatgcagtacgagctgaacaggaacaacgtgacggacccgtcactctccgagatggtggtggtggccatccagatcctgcggaagaaccccaaaggcttcttcttgctggtggaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaggaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatattaaaaaaaaaaaaaaaaaaaaaaaaaaaaaaaaaaaaaaaaaaaaaaaaaaaaaaaaaaacaagaaaaaaaaaaaaaaaaacaaaaacaaaacaaaaaaaacaaaaaagaaaaaaagcgaggagggccggcccgatagaaacattcattcaggggagccgaaccacaagagcaaaccaaccccgagttatagaagagagaggggacgtcaccaaagagagaagaagtatgtattttgtttgcggtgggtgggtgggtgagtgaaaaaaaaaacgagaggagaaaagaaaggcgcacgcgtggatctctatagggaaagagcaacctactgtgcggtggggagagaacacgtgagcgcggccagaagg

SEQ ID NO: 437084 - DNA, 2518 bp, Homo sapiens
ggctggtacggccggaagtgatggatctggctccgtgctcccacgcgcttgtgcctggacggaccctcgccagtgctctgcgcaggattggaacatcagttaacatctgaccactgccagcccaccccctcccacccacgtcgattgcatctctgggctccagggataaagcaggtcttggggtgcaccatgatttcaccattcttagtactggccattggcacctgccttactaactccttagtgccagagaaagagaaagaccccaagtactggcgagaccaagcgcaagagacactgaaatatgccctggagcttcagaagctcaacaccaacgtggctaagaatgtcatcatgttcctgggagatgggatgggtgtctccacagtgacggctgcccgcatcctcaagggtcagctccaccacaaccctggggaggagaccaggctggagatggacaagttccccttcgtggccctctccaagacgtacaacaccaatgcccaggtccctgacagcgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagcactcccacttcatctggaaccgcacggaactcctgacccttgacccccacaatgtggactacctattgggtctcttcgagccaggggacatgcagtacgagctgaacaggaacaacgtgacggacccgtcactctccgagatggtggtggtggccatccagatcctgcggaagaaccccaaaggcttcttcttgctggtggaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaggaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatt

SEQ ID NO: 437085 - DNA, 2620 bp, Homo sapiens
gggacacgtgggcagagacggataaagacagagacccagagaaagccagatatgttgacagacacagagacagacgccagagaggaaggcagacaaagagacgggtggagacaaagactcccaccaagagacgcagaaggaagatgccgacggtaaagacaaaacaggagacgcgcgcaaggagcaggattggaacatcagttaacatctgaccactgccagcccaccccctcccacccacgtcgattgcatctctgggctccagggataaagcaggtcttggggtgcaccatgatttcaccattcttagtactggccattggcacctgccttactaactccttagtgccagagaaagagaaagaccccaagtactggcgagaccaagcgcaagagacactgaaatatgccctggagcttcagaagctcaacaccaacgtggctaagaatgtcatcatgttcctgggagatgggatgggtgtctccacagtgacggctgcccgcatcctcaagggtcagctccaccacaaccctggggaggagaccaggctggagatggacaagttccccttcgtggccctctccaagacgtacaacaccaatgcccaggtccctgacagcgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagcactcccacttcatctggaaccgcacggaactcctgacccttgacccccacaatgtggactacctattgggtctcttcgagccaggggacatgcagtacgagctgaacaggaacaacgtgacggacccgtcactctccgagatggtggtggtggccatccagatcctgcggaagaaccccaaaggcttcttcttgctggtggaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaggaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatt

SEQ ID NO: 437086 - DNA, 1531 bp, Homo sapiens
gctgtccctctctggcctccgtcaggttgaatggctgcgtaaaatgcctaggctgtggtgctagctcagagtggtgcccggcgaaggttcctgtccttccctagctaacaaaggttaatccagcagcagtgttgtggggctggggagcagatcttcctcccctcctccctcaccgaggcctttgccttggtgtcccaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaggaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatt

SEQ ID NO: 437087 - DNA, 1140 bp, Homo sapiens
caattgtgctactcaaatcacagtttggatccaggcgctgtaatctttcctcaccctctgtccagtagattcatcaccattctcgatttaggaatgctttaaagatgcttgttatttggaacatatttgagaaagtgacaggaacgtggcaaacaagctgccttaaacagagactgtacctagacctagagtgtaatatcaacttgtcaagtatatcttctgcaactttgctttttgaaagcctagcacaaagtagatcatgagtaaaatgtgattgccgataattacatggagaaatgtgaataaatgactctttaaaccctgtaaactaaactcggcttaaaataggtggtttgaacatttgggaaaccttagttttccctgaaatccaatccttgcaaagcaataatgacaagaggtggataaagcggacttacagaaaagggcgtcttaccggtcccctctaatcacaccatcccccctcttttaaaaaaattttcttctcagataaccaagttaaatctagctcaaatgaaccttttagtttttgaggagggcaataatagtagtgaacaccaaaacgaaaggggatctgggcttcaaaatactaacagttctatttcctagccagtcgtctcccgggctggatgtgccgccgtcccagatctcagcggcggccgcagagcgcagaggtagggagagaaaaaggaggcgtcggcggggcgcgagcgaccagggcgctaagtgccgcctcacagtcctgccagagacaggagacgccgggccgcccgcgccgtctgtcccaagagctcctcctggacatccgcttgactctccgtcgtctccaattggccgtcggggaacggaagccgaagcaaactagtgaacccggaagtgcttcgcggcggaggcccgggcaactcttttgaatggaatcgggctgattcatcgccggtttgcagactgagccgcgtcgggtgtgcgccgctgctgctgttgcctctgtcttcgcgtcaccacagaggcaagacaagggtccatatcgcggcatccggctcccgcccgtcttcaggtaagacccagaaggcaggcctgggaggtctggggaggcagccgtgctaggccgccgccagccccgtg

SEQ ID NO: 437088 - DNA, 1511 bp, Homo sapiens
caattgtgctactcaaatcacagtttggatccaggcgctgtaatctttcctcaccctctgtccagtagattcatcaccattctcgatttaggaatgctttaaagatgcttgttatttggaacatatttgagaaagtgacaggaacgtggcaaacaagctgccttaaacagagactgtacctagacctagagtgtaatatcaacttgtcaagtatatcttctgcaactttgctttttgaaagcctagcacaaagtagatcatgagtaaaatgtgattgccgataattacatggagaaatgtgaataaatgactctttaaaccctgtaaactaaactcggcttaaaataggtggtttgaacatttgggaaaccttagttttccctgaaatccaatccttgcaaagcaataatgacaagaggtggataaagcggacttacagaaaagggcgtcttaccggtcccctctaatcacaccatcccccctcttttaaaaaaattttcttctcagataaccaagttaaatctagctcaaatgaaccttttagtttttgaggagggcaataatagtagtgaacaccaaaacgaaaggggatctgggcttcaaaatactaacagttctatttcctagccagtcgtctcccgggctggatgtgccgccgtcccagatctcagcggcggccgcagagcgcagaggtagggagagaaaaaggaggcgtcggcggggcgcgagcgaccagggcgctaagtgccgcctcacagtcctgccagagacaggagacgccgggccgcccgcgccgtctgtcccaagagctcctcctggacatccgcttgactctccgtcgtctccaattggccgtcggggaacggaagccgaagcaaactagtgaacccggaagtgcttcgcggcggaggcccgggcaactcttttgaatggaatcgggctgattcatcgccggtttgcagactgagccgcgtcgggtgtgcgccgctgctgctgttgcctctgtcttcgcgtcaccacagaggcaagacaagggtccatatcgcggcatccggctcccgcccgtcttcaggagagaaagaaaaaataaaatatacttggggaagttgtacctgccagaattagcaagagctttctttaagaagacatttgtcaaactcaacaaattgaaggttaacaccttaagagttgtagttactgaccagaaatatggacagacttcttagacttggaggaggtatgcctggactgggccagatggagtcttgctctgtcacccaggctagagtgcagtggcatgatcttggctcattgcaacctccacctcctggactcaagagattcttctgcctcagcctcctgagtatcacagaattaatgcaccatctggaaacctctgagatcatgccataaaaggaatttggacttttttggcaaccaatcatcagactatgctgtgattatgcaccttatcagaataataaaacataattggaaaggtgaaataaaaa

SEQ ID NO: 437089 - DNA, 1636 bp, Homo sapiens
caattgtgctactcaaatcacagtttggatccaggcgctgtaatctttcctcaccctctgtccagtagattcatcaccattctcgatttaggaatgctttaaagatgcttgttatttggaacatatttgagaaagtgacaggaacgtggcaaacaagctgccttaaacagagactgtacctagacctagagtgtaatatcaacttgtcaagtatatcttctgcaactttgctttttgaaagcctagcacaaagtagatcatgagtaaaatgtgattgccgataattacatggagaaatgtgaataaatgactctttaaaccctgtaaactaaactcggcttaaaataggtggtttgaacatttgggaaaccttagttttccctgaaatccaatccttgcaaagcaataatgacaagaggtggataaagcggacttacagaaaagggcgtcttaccggtcccctctaatcacaccatcccccctcttttaaaaaaattttcttctcagataaccaagttaaatctagctcaaatgaaccttttagtttttgaggagggcaataatagtagtgaacaccaaaacgaaaggggatctgggcttcaaaatactaacagttctatttcctagccagtcgtctcccgggctggatgtgccgccgtcccagatctcagcggcggccgcagagcgcagaggtagggagagaaaaaggaggcgtcggcggggcgcgagcgaccagggcgctaagtgccgcctcacagtcctgccagagacaggagacgccgggccgcccgcgccgtctgtcccaagagctcctcctggacatccgcttgactctccgtcgtctccaattggccgtcggggaacggaagccgaagcaaactagtgaacccggaagtgcttcgcggcggaggcccgggcaactcttttgaatggaatcgggctgattcatcgccggtttgcagactgagccgcgtcgggtgtgcgccgctgctgctgttgcctctgtcttcgcgtcaccacagaggcaagacaagggtccatatcgcggcatccggctcccgcccgtcttcaggagagaaagaaaaaataaaatatacttggggaagttgtacctgccagaattagcaagagctttctttaagaagacatttgtcaaactcaacaaattgaaggttaacaccttaagagttgtagttactgaccagaaatatggacagacttcttagacttggaggaggtatgcctggactgggccaggttagtatatagtctcttgagcatttccttgtgtgtaaactacaagcctttttgtagttagccaaagagaaagaaattatccccaagaaaatcacctaacagataactctatggtaagaatcttaccttattgatgtttgttatcttgcaacactagataacatgtggaaaacatttattgtcttagtttacttttctcctgggaataagaattttctgttatttgctttgtttaaaattttgagatatgtaggattatcaaagttggcttttaggaaaaaaaaaccctcaaaatagcttacttcctgaatttacagtgtaaactttagatgtaacacaagaaaaagtaagcatgtcatcctgcttgccagatccagaa

SEQ ID NO: 437090 - DNA, 966 bp, Homo sapiens
ctgggattacaggaatgagccaccgtgcctggcctaagagttatttttgatcagaggcatgatatgcttagaacctgactttagaaacatgatttcacaacagtatagaaggaacactgtaagagaagatttgaaatggagagtgtgtttaagaggagcttgctactacccaaacaaaaggctgtagaagaagaagataagatgacacctgaacagctggcaataaagaatgttggcaagcaggaccccaaacgtcatttggaggaacatgtggatgtacttatgacctcaaatattgtccagtgtttagcagctatgttggatactgtcgtatttaaataaagcaacgaaaaacgctattaatgatgccttcagtgtatattcctctgttgttcctaatgctcaaaatcaagggacctctgaaggtgtacttggctaaatgtaagacatctggcatcatttgcagcactgtaacaccttcagtctcagttgtgcaattacttctgtttctttagtcagggtctttgcagattctaaagttatacatgaatacatcaaagtggacaaattttgttaagatcccatttaatatttgaaaaaatcagtagcacaaatatattttgattgtcacttacaaaataaaatacatttacagtctaaaaaaaaaaaacaacacaggcattctgtgccaccccacccccgcaactcaccctcccagctgccctccttgccctccgcgcgggaaaccttgcaggcgtctgtctcctcgaccggcgggtaatctactgacgttcgcaaccggaactacgccagcctcgaacattcggtggcgccacctgaatcagctcatcagaacgaggagctcaagctccccccaaaccccccgtatcaacgccatagaccccctcctatctaaagggcacccacttcaatttaattaaatacacgcccccaacccacgcaaag

SEQ ID NO: 437091 - DNA, 2630 bp, Homo sapiens
caattgtgctactcaaatcacagtttggatccaggcgctgtaatctttcctcaccctctgtccagtagattcatcaccattctcgatttaggaatgctttaaagatgcttgttatttggaacatatttgagaaagtgacaggaacgtggcaaacaagctgccttaaacagagactgtacctagacctagagtgtaatatcaacttgtcaagtatatcttctgcaactttgctttttgaaagcctagcacaaagtagatcatgagtaaaatgtgattgccgataattacatggagaaatgtgaataaatgactctttaaaccctgtaaactaaactcggcttaaaataggtggtttgaacatttgggaaaccttagttttccctgaaatccaatccttgcaaagcaataatgacaagaggtggataaagcggacttacagaaaagggcgtcttaccggtcccctctaatcacaccatcccccctcttttaaaaaaattttcttctcagataaccaagttaaatctagctcaaatgaaccttttagtttttgaggagggcaataatagtagtgaacaccaaaacgaaaggggatctgggcttcaaaatactaacagttctatttcctagccagtcgtctcccgggctggatgtgccgccgtcccagatctcagcggcggccgcagagcgcagaggtagggagagaaaaaggaggcgtcggcggggcgcgagcgaccagggcgctaagtgccgcctcacagtcctgccagagacaggagacgccgggccgcccgcgccgtctgtcccaagagctcctcctggacatccgcttgactctccgtcgtctccaattggccgtcggggaacggaagccgaagcaaactagtgaacccggaagtgcttcgcggcggaggcccgggcaactcttttgaatggaatcgggctgattcatcgccggtttgcagactgagccgcgtcgggtgtgcgccgctgctgctgttgcctctgtcttcgcgtcaccacagaggcaagacaagggtccatatcgcggcatccggctcccgcccgtcttcaggagagaaagaaaaaataaaatatacttggggaagttgtacctgccagaattagcaagagctttctttaagaagacatttgtcaaactcaacaaattgaaggttaacaccttaagagttgtagttactgaccagaaatatggacagacttcttagacttggaggaggtatgcctggactgggccaggggccacctacagatgctcctgcagtggacacagcagaacaagtctatatctcttccctggcactgttaaaaatgttaaaacatggccgtgctggagttccaatggaagttatgggtttgatgcttggagaatttgttgatgattataccgtcagagtgattgatgtgtttgctatgccacagtcaggaacaggtgtcagtgtggaggcagttgatccagtgttccaagctaaaatgttggatatgttgaagcagacaggaaggccggagatggttgttggttggtatcacagtcaccctggctttggttgttggctttctggtgtggatatcaacactcagcagagctttgaagccttgtcggagagagctgtggcagtggttgtggatcccattcagagtgtaaaaggaaaggttgttattgatgccttcagattgatcaatgctaatatgatggtcttaggacatgaaccaagacaaacaacttcgaatctgggtcacttaaacaagccatctatccaggcattaattcatggactaaacagacattattactccattactattaactatcggaaaaatgaactggaacagaagatgttgctaaatttgcataagaagagttggatggaaggtttgacacttcaggactacagtgaacattgtaaacacaatgaatcagtggtaaaagagatgttggaattagccaagaattacaataaggctgtagaagaagaagataagatgacacctgaacagctggcaataaagaatgttggcaagcaggaccccaaacgtcatttggaggaacatgtggatgtacttatgacctcaaatattgtccagtgtttagcagctatgttggatactgtcgtatttaaataaagcaacgaaaaacgctattaatgatgccttcagtgtatattcctctgttgttcctaatgctcaaaatcaagggacctctgaaggtgtacttggctaaatgtaagacatctggcatcatttgcagcactgtaacaccttcagtctcagttgtgcaattacttctgtttctttagtcagggtctttgcagattctaaagttatacatgaatacatcaaagtggacaaattttgttaagatcccatttaatatttgaaaaaatcagtagcacaaatatattttgattgtcacttacaaaataaaatacatttacagtctaaaaaaaaaaatagatggagagagtggtgaaatagtcacagaagtgtgatgagtgtattatttaaaacgcagagtttatttgccccggccggcccctctttttttggagaggaaattaaaaaaaccccgaacaacgcactgcgcctggagaaagaagggggagaatatattt

SEQ ID NO: 437092 - DNA, 2483 bp, Homo sapiens
caattgtgctactcaaatcacagtttggatccaggcgctgtaatctttcctcaccctctgtccagtagattcatcaccattctcgatttaggaatgctttaaagatgcttgttatttggaacatatttgagaaagtgacaggaacgtggcaaacaagctgccttaaacagagactgtacctagacctagagtgtaatatcaacttgtcaagtatatcttctgcaactttgctttttgaaagcctagcacaaagtagatcatgagtaaaatgtgattgccgataattacatggagaaatgtgaataaatgactctttaaaccctgtaaactaaactcggcttaaaataggtggtttgaacatttgggaaaccttagttttccctgaaatccaatccttgcaaagcaataatgacaagaggtggataaagcggacttacagaaaagggcgtcttaccggtcccctctaatcacaccatcccccctcttttaaaaaaattttcttctcagataaccaagttaaatctagctcaaatgaaccttttagtttttgaggagggcaataatagtagtgaacaccaaaacgaaaggggatctgggcttcaaaatactaacagttctatttcctagccagtcgtctcccgggctggatgtgccgccgtcccagatctcagcggcggccgcagagcgcagaggtagggagagaaaaaggaggcgtcggcggggcgcgagcgaccagggcgctaagtgccgcctcacagtcctgccagagacaggagacgccgggccgcccgcgccgtctgtcccaagagctcctcctggacatccgcttgactctccgtcgtctccaattggccgtcggggaacggaagccgaagcaaactagtgaacccggaagtgcttcgcggcggaggcccgggcaactcttttgaatggaatcgggctgattcatcgccggtttgcagactgagccgcgtcgggtgtgcgccgctgctgctgttgcctctgtcttcgcgtcaccacagaggcaagacaagggtccatatcgcggcatccggctcccgcccgtcttcaggagagaaagaaaaaataaaatatacttggggaagttgtacctgccagaattagcaagagctttctttaagaagacatttgtcaaactcaacaaattgaaggttaacaccttaagagttgtagttactgaccagaaatatggacagacttcttagacttggaggaggtatgcctggactgggccaggggccacctacagatgctcctgcagtggacacagcagaacaagtctatatctcttccctggcactgttaaaaatgttaaaacatggccgtgctggagttccaatggaagttatgggtttgatgcttggagaatttgttgatgattataccgtcagagtgattgatgtgtttgctatgccacagtcaggaacaggtgtcagtgtggaggcagttgatccagtgttccaagctaaaatgttggatatgttgaagcagacaggaaggccggagatggttgttggttggtatcacagtcaccctggctttggttgttggctttctggtgtggatatcaacactcagcagagctttgaagccttgtcggagagagctgtggcagtggttgtggatcccattcagagtgtaaaaggaaaggttgttattgatgccttcagattgatcaatgctaatatgatggtcttaggacatgaaccaagacaaacaacttcgaatctgggtcacttaaacaagccatctatccaggcattaattcatggactaaacagacattattactccattactattaactatcggaaaaatgaactggaacagaagatgttgctaaatttgcataagaagagttggatggaaggtttgacacttcaggactacagtgaacattgtaaacacaatgaatcagtggtaaaagagatgttggaattagccaagaattacaataaggctgtagaagaagaagataagatgacacctgaacagctggcaataaagaatgttggcaagcaggaccccaaacgtcatttggaggaacatgtggatgtacttatgacctcaaatattgtccagtgtttagcagctatgttggatactgtcgtatttaaataaagcaacgaaaaacgctattaatgatgccttcagtgtatattcctctgttgttcctaatgctcaaaatcaagggacctctgaaggtgtacttggctaaatgtaagacatctggcatcatttgcagcactgtaacaccttcagtctcagttgtgcaattacttctgtttctttagtcagggtctttgcagattctaaagttatacatgaatacatcaaagtggacaaattttgttaagatcccatttaatatttgaaaaaatcagtagcacaaatatattttgattgtcacttacaaaataaaatacatttacagtctaatgcctcctgagatctttttggca

SEQ ID NO: 437093 - DNA, 2451 bp, Homo sapiens
  misc_feature (2428)..(2428): n is a, c, g, or t
caattgtgctactcaaatcacagtttggatccaggcgctgtaatctttcctcaccctctgtccagtagattcatcaccattctcgatttaggaatgctttaaagatgcttgttatttggaacatatttgagaaagtgacaggaacgtggcaaacaagctgccttaaacagagactgtacctagacctagagtgtaatatcaacttgtcaagtatatcttctgcaactttgctttttgaaagcctagcacaaagtagatcatgagtaaaatgtgattgccgataattacatggagaaatgtgaataaatgactctttaaaccctgtaaactaaactcggcttaaaataggtggtttgaacatttgggaaaccttagttttccctgaaatccaatccttgcaaagcaataatgacaagaggtggataaagcggacttacagaaaagggcgtcttaccggtcccctctaatcacaccatcccccctcttttaaaaaaattttcttctcagataaccaagttaaatctagctcaaatgaaccttttagtttttgaggagggcaataatagtagtgaacaccaaaacgaaaggggatctgggcttcaaaatactaacagttctatttcctagccagtcgtctcccgggctggatgtgccgccgtcccagatctcagcggcggccgcagagcgcagaggtagggagagaaaaaggaggcgtcggcggggcgcgagcgaccagggcgctaagtgccgcctcacagtcctgccagagacaggagacgccgggccgcccgcgccgtctgtcccaagagctcctcctggacatccgcttgactctccgtcgtctccaattggccgtcggggaacggaagccgaagcaaactagtgaacccggaagtgcttcgcggcggaggcccgggcaactcttttgaatggaatcgggctgattcatcgccggtttgcagactgagccgcgtcgggtgtgcgccgctgctgctgttgcctctgtcttcgcgtcaccacagaggcaagacaagggtccatatcgcggcatccggctcccgcccgtcttcaggagagaaagaaaaaataaaatatacttggggaagttgtacctgccagaattagcaagagctttctttaagaagacatttgtcaaactcaacaaattgaaggttaacaccttaagagttgtagttactgaccagaaatatggacagacttcttagacttggaggaggtatgcctggactgggccaggggccacctacagatgctcctgcagtggacacagcagaacaagtctatatctcttccctggcactgttaaaaatgttaaaacatggccgtgctggagttccaatggaagttatgggtttgatgcttggagaatttgttgatgattataccgtcagagtgattgatgtgtttgctatgccacagtcaggaacaggtgtcagtgtggaggcagttgatccagtgttccaagctaaaatgttggatatgttgaagcagacaggaaggccggagatggttgttggttggtatcacagtcaccctggctttggttgttggctttctggtgtggatatcaacactcagcagagctttgaagccttgtcggagagagctgtggcagtggttgtggatcccattcagagtgtaaaaggaaaggttgttattgatgccttcagattgatcaatgctaatatgatggtcttaggacatgaaccaagacaaacaacttcgaatctgggtcacttaaacaagccatctatccaggcattaattcatggactaaacagacattattactccattactattaactatcggaaaaatgaactggaacagaagatgttgctaaatttgcataagaagagttggatggaaggtttgacacttcaggactacagtgaacattgtaaacacaatgaatcagtggtaaaagagatgttggaattagccaagaattacaataaggctgtagaagaagaagataagatgacacctgaacagctggcaataaagaatgttggcaagcaggaccccaaacgtcatttggaggaacatgtggatgtacttatgacctcaaatattgtccagtgtttagcagctatgttggatactgtcgtatttaaataaagcaacgaaaaacgctattaatgatgccttcagtgtatattcctctgttgttcctaatgctcaaaatcaagggacctctgaaggtgtacttggctaaatgtaagacatctggcatcatttgcagcactgtaacaccttcagtctcagttgtgcaattacttctgtttctttagtcagggtctttgcagattctaaagttatacatgaatacatcaaagtggacaaattgagggcgcgctgctcggggcggtcgaggcggcgcgcaggctggcgtagccgcggtgtncggcgggcgagcggccggcggcg

SEQ ID NO: 437094 - DNA, 1237 bp, Homo sapiens
  misc_feature (22)..(23): n is a, c, g, or t
  misc_feature (35)..(35): n is a, c, g, or t
catgctgaacgactctctaatnnccaccgctacangggccacctacagatgctcctgcagtggacacagcagaacaagtctatatctcttccctggcactgttaaaaatgttaaaacatggccgtgctggagttccaatggaagttatgggtttgatgcttggagaatttgttgatgattataccgtcagagtgattgatgtgtttgctatgccacagtcaggaacaggtgtcagtgtggaggcagttgatccagtgttccaagctaaaatgttggatatgttgaagcagacaggaaggccggagatggttgttggttggtatcacagtcaccctggctttggttgttggctttctggtgtggatatcaacactcagcagagctttgaagccttgtcggagagagctgtggcagtggttgtggatcccattcagagtgtaaaaggaaaggttgttattgatgccttcagattgatcaatgctaatatgatggtcttaggacatgaaccaagacaaacaacttcgaatctgggtcacttaaacaagccatctatccaggcattaattcatggactaaacagacattattactccattactattaactatcggaaaaatgaactggaacagaagatgttgctaaatttgcataagaagagttggatggaaggtttgacacttcaggactacagtgaacattgtaaacacaatgaatcagtggtaaaagagatgttggaattagccaagaattacaataaggctgtagaagaagaagataagatgacacctgaacagctggcaataaagaatgttggcaagcaggaccccaaacgtcatttggaggaacatgtggatgtacttatgacctcaaatattgtccagtgtttagcagctatgttggatactgtcgtatttaaataaagcaacgaaaaacgctattaatgatgccttcagtgtatattcctctgttgttcctaatgctcaaaatcaagggacctctgaaggtgtacttggctaaatgtaagacatctggcatcatttgcagcactgtaacaccttcagtctcagttgtgcaattacttctgtttctttagtcagggtctttgcagattctaaagttatacatgaatacatcaaagtggacaaattttgttaagatcccatttaatatttgaaaaaatcagtagcacaaatatattttgattgtcacttacaaaataaaatacatttacagtcta

SEQ ID NO: 437095 - DNA, 2212 bp, Homo sapiens
  misc_feature (2164)..(2165): n is a, c, g, or t
caattgtgctactcaaatcacagtttggatccaggcgctgtaatctttcctcaccctctgtccagtagattcatcaccattctcgatttaggaatgctttaaagatgcttgttatttggaacatatttgagaaagtgacaggaacgtggcaaacaagctgccttaaacagagactgtacctagacctagagtgtaatatcaacttgtcaagtatatcttctgcaactttgctttttgaaagcctagcacaaagtagatcatgagtaaaatgtgattgccgataattacatggagaaatgtgaataaatgactctttaaaccctgtaaactaaactcggcttaaaataggtggtttgaacatttgggaaaccttagttttccctgaaatccaatccttgcaaagcaataatgacaagaggtggataaagcggacttacagaaaagggcgtcttaccggtcccctctaatcacaccatcccccctcttttaaaaaaattttcttctcagataaccaagttaaatctagctcaaatgaaccttttagtttttgaggagggcaataatagtagtgaacaccaaaacgaaaggggatctgggcttcaaaatactaacagttctatttcctagccagtcgtctcccgggctggatgtgccgccgtcccagatctcagcggcggccgcagagcgcagaggtagggagagaaaaaggaggcgtcggcggggcgcgagcgaccagggcgctaagtgccgcctcacagtcctgccagagacaggagacgccgggccgcccgcgccgtctgtcccaagagctcctcctggacatccgcttgactctccgtcgtctccaattggccgtcggggaacggaagccgaagcaaactagtgaacccggaagtgcttcgcggcggaggcccgggcaactcttttgaatggaatcgggctgattcatcgccggtttgcagactgagccgcgtcgggtgtgcgccgctgctgctgttgcctctgtcttcgcgtcaccacagaggcaagacaagggtccatatcgcggcatccggctcccgcccgtcttcaggagagaaagaaaaaataaaatatacttggggaagttgtacctgccagaattagcaagagctttctttaagaagacatttgtcaaactcaacaaattgaaggttaacaccttaagagttgtagttactgaccagaaatatggacagacttcttagacttggaggaggtatgcctggactgggccaggggccacctacagatgctcctgcagtggacacagcagaacaagtctatatctcttccctggcactgttaaaaatgttaaaacatggccgtgctggagttccaatggaagttatgggtttgatgcttggagaatttgttgatgattataccgtcagagtgattgatgtgtttgctatgccacagtcaggaacaggtgtcagtgtggaggcagttgatccagtgttccaagctaaaatgttggatatgttgaagcagacaggaaggccggagatggttgttggttggtatcacagtcaccctggctttggttgttggctttctggtgtggatatcaacactcagcagagctttgaagccttgtcggagagagctgtggcagtggttgtggatcccattcagagtgtaaaaggaaaggttgttattgatgccttcagattgatcaatgctaatatgatggtcttaggacatgaaccaagacaaacaacttcgaatctgggtcacttaaacaagccatctatccaggcattaattcatggactaaacagacattattactccattactattaactatcggaaaaatgaactggaacagaagatgttgctaaatttgcataagaagagttggatggaaggtttgacacttcaggactacagtgaacattgtaaacacaatgaatcagtggtaaaagagatgttggaattagccaagaattacaataaggctgtagaagaagaagataagatgacacctgaacagctggcaataaagaatgttggcaagcaggaccccaaacgtcatttggaggaacatgtggatgtacttatgacctcaaatattgtccagtgtttagcagctatgttggatactgtcgtatttaaataaagcaacgaaaaacggagccgcnnctcttataattattaaaataatgataagttatatatataccgataag

SEQ ID NO: 437096 - DNA, 857 bp, Homo sapiens
ttagggcagtttgtccgggattgtgcatccttccggggttgtggatcccattcagagtgtcaaaggaaagttgttattgatgccttcagattgatcaatgctaatatgatggtcttaggacatgaaccaagacaaacaacttcgaatctgggtcacttaaacaagccatctatccaggcattaattcatggactaaacagacattattactccattactattaactatcggaaaaatgaactggaacagaagatgttgctaaatttgcataagaagagttggatggaaggtttgacacttcaggactacagtgaacattgtaaacacaatgaatcagtggtaaaagagatgttggaattagccaagaattacaataaggctgtagaagaagaagataagatgacacctgaacagctggcaataaagaatgttggcaagcaggaccccaaacgtcatttggaggaacatgtggatgtacttatgacctcaaatattgtccagtgtttagcagctatgttggatactgtcgtatttaaataaagcaacgaaaaacgctattaatgatgccttcagtgtatattcctctgttgttcctaatgctcaaaatcaagggacctctgaaggtgtacttggctaaatgtaagacatctggcatcatttgcagcactgtaacaccttcagtctcagttgtgcaattacttctgtttctttagtcagggtctttgcagattctaaagttatacatgaatacatcaaagtggacaaattttgttaagatcccatttaatatttgaaaaaatcagtagcacaaatatattttgattgtcacttacaaaataaaatacatttacagtcta

SEQ ID NO: 437097 - DNA, 659 bp, Homo sapiens
ctgggattacaggaatgagccaccgtgcctggcctaagagttatttttgatcagaggcatgatatgcttagaacctgactttagaaacatgatttcacaacagtatagaaggaacactgtaagagaagatttgaaatggagagtgtgtttaagaggagcttgctactacccaaacaaaaggctgtagaagaagaagataagatgacacctgaacagctggcaataaagaatgttggcaagcaggaccccaaacgtcatttggaggaacatgtggatgtacttatgacctcaaatattgtccagtgtttagcagctatgttggatactgtcgtatttaaataaagcaacgaaaaacgctattaatgatgccttcagtgtatattcctctgttgttcctaatgctcaaaatcaagggacctctgaaggtgtacttggctaaatgtaagacatctggcatcatttgcagcactgtaacaccttcagtctcagttgtgcaattacttctgtttctttagtcagggtctttgcagattctaaagttatacatgaatacatcaaagtggacaaattttgttaagatcccatttaatatttgaaaaaatcagtagcacaaatatattttgattgtcacttacaaaataaaatacatttacagtcta

SEQ ID NO: 437098 - DNA, 539 bp, Homo sapiens
acaatacatcattatcattaatttacaatcactcctacgtttgtggaatctatgctctccgctgtagaagaagaagataagatgacacctgaacagctggcaataaagaatgttggcaagcaggaccccaaacgtcatttggaggaacatgtggatgtacttatgacctcaaatattgtccagtgtttagcagctatgttggatactgtcgtatttaaataaagcaacgaaaaacgctattaatgatgccttcagtgtatattcctctgttgttcctaatgctcaaaatcaagggacctctgaaggtgtacttggctaaatgtaagacatctggcatcatttgcagcactgtaacaccttcagtctcagttgtgcaattacttctgtttctttagtcagggtctttgcagattctaaagttatacatgaatacatcaaagtggacaaattttgttaagatcccatttaatatttgaaaaaatcagtagcacaaatatattttgattgtcacttacaaaataaaatacatttacagtcta

SEQ ID NO: 437099 - DNA, 546 bp, Homo sapiens
tcacactctacacttcaccaaaacctttacctccacattacagatgacaccatctgagctgacgcaagctgtagaagaagaagataagatgacacctgaacagctggcaataaagaatgttggcaagcaggaccccaaacgtcatttggaggaacatgtggatgtacttatgacctcaaatattgtccagtgtttagcagctatgttggatactgtcgtatttaaataaagcaacgaaaaacgctattaatgatgccttcagtgtatattcctctgttgttcctaatgctcaaaatcaagggacctctgaaggtgtacttggctaaatgtaagacatctggcatcatttgcagcactgtaacaccttcagtctcagttgtgcaattacttctgtttctttagtcagggtctttgcagattctaaagttatacatgaatacatcaaagtggacaaattttgttaagatcccatttaatatttgaaaaaatcagtagcacaaatatattttgattgtcacttacaaaataaaatacatttacagtcta

SEQ ID NO: 437100 - DNA, 2459 bp, Homo sapiens
caattgtgctactcaaatcacagtttggatccaggcgctgtaatctttcctcaccctctgtccagtagattcatcaccattctcgatttaggaatgctttaaagatgcttgttatttggaacatatttgagaaagtgacaggaacgtggcaaacaagctgccttaaacagagactgtacctagacctagagtgtaatatcaacttgtcaagtatatcttctgcaactttgctttttgaaagcctagcacaaagtagatcatgagtaaaatgtgattgccgataattacatggagaaatgtgaataaatgactctttaaaccctgtaaactaaactcggcttaaaataggtggtttgaacatttgggaaaccttagttttccctgaaatccaatccttgcaaagcaataatgacaagaggtggataaagcggacttacagaaaagggcgtcttaccggtcccctctaatcacaccatcccccctcttttaaaaaaattttcttctcagataaccaagttaaatctagctcaaatgaaccttttagtttttgaggagggcaataatagtagtgaacaccaaaacgaaaggggatctgggcttcaaaatactaacagttctatttcctagccagtcgtctcccgggctggatgtgccgccgtcccagatctcagcggcggccgcagagcgcagaggtagggagagaaaaaggaggcgtcggcggggcgcgagcgaccagggcgctaagtgccgcctcacagtcctgccagagacaggagacgccgggccgcccgcgccgtctgtcccaagagctcctcctggacatccgcttgactctccgtcgtctccaattggccgtcggggaacggaagccgaagcaaactagtgaacccggaagtgcttcgcggcggaggcccgggcaactcttttgaatggaatcgggctgattcatcgccggtttgcagactgagccgcgtcgggtgtgcgccgctgctgctgttgcctctgtcttcgcgtcaccacagaggcaagacaagggtccatatcgcggcatccggctcccgcccgtcttcaggagagaaagaaaaaataaaatatacttggggaagttgtacctgccagaattagcaagagctttctttaagaagacatttgtcaaactcaacaaattgaaggttaacaccttaagagttgtagttactgaccagaaatatggacagacttcttagacttggaggaggtatgcctggactgggccaggggccacctacagatgctcctgcagtggacacagcagaacaagtctatatctcttccctggcactgttaaaaatgttaaaacatggccgtgctggagttccaatggaagttatgggtttgatgcttggagaatttgttgatgattataccgtcagagtgattgatgtgtttgctatgccacagtcaggaacaggtgtcagtgtggaggcagttgatccagtgttccaagctaaaatgttggatatgttgaagcagacaggaaggccggagatggttgttggttggtatcacagtcaccctggctttggttgttggctttctggtgtggatatcaacactcagcagagctttgaagccttgtcggagagagctgtggcagtggttgtggatcccattcagagtgtaaaaggaaaggttgttattgatgccttcagattgatcaatgctaatatgatggtcttaggacatgaaccaagacaaacaacttcgaatctgggtcacttaaacaagccatctatccaggcattaattcatggactaaacagacattattactccattactattaactatcggaaaaatgaactggaacagaagatgttgctaaatttgcataagaagagttggatggaaggtttgacacttcaggactacagtgaacattgtaaacacaatgaatcagtggtaaaagagatgttggaattagccaagaattacaataaggctgtagaagaagaagataagatgacacctgaacagctggcaataaagaatgttggcaagcaggaccccaaacgtcatttggaggaacatgtggatgtacttatgacctcaaatattgtccagtgtttagcagctatgttggatactgtcgtatttaaataaagcaacgaaaaacgctattaatgatgccttcagtgtatattcctctgttgttcctaatgctcaaaatcaagggacctctgaaggtgtacttggctaaatgtaagacatctggcatcatttgcagcactgtaacaccttcagtctcagttgtgcaattacttctgtttctttagtcagggtctttgcagattctaaagttatacatgaatacatcaaagtggacaaattttgttaagatcccatttaatatttgaaaaaatcagtagcacaaatatattttgattgtcacttacaaaataaaatacatttacagtcta

SEQ ID NO: 437101 - DNA, 2766 bp, Homo sapiens
caattgtgctactcaaatcacagtttggatccaggcgctgtaatctttcctcaccctctgtccagtagattcatcaccattctcgatttaggaatgctttaaagatgcttgttatttggaacatatttgagaaagtgacaggaacgtggcaaacaagctgccttaaacagagactgtacctagacctagagtgtaatatcaacttgtcaagtatatcttctgcaactttgctttttgaaagcctagcacaaagtagatcatgagtaaaatgtgattgccgataattacatggagaaatgtgaataaatgactctttaaaccctgtaaactaaactcggcttaaaataggtggtttgaacatttgggaaaccttagttttccctgaaatccaatccttgcaaagcaataatgacaagaggtggataaagcggacttacagaaaagggcgtcttaccggtcccctctaatcacaccatcccccctcttttaaaaaaattttcttctcagataaccaagttaaatctagctcaaatgaaccttttagtttttgaggagggcaataatagtagtgaacaccaaaacgaaaggggatctgggcttcaaaatactaacagttctatttcctagccagtcgtctcccgggctggatgtgccgccgtcccagatctcagcggcggccgcagagcgcagaggtagggagagaaaaaggaggcgtcggcggggcgcgagcgaccagggcgctaagtgccgcctcacagtcctgccagagacaggagacgccgggccgcccgcgccgtctgtcccaagagctcctcctggacatccgcttgactctccgtcgtctccaattggccgtcggggaacggaagccgaagcaaactagtgaacccggaagtgcttcgcggcggaggcccgggcaactcttttgaatggaatcgggctgattcatcgccggtttgcagactgagccgcgtcgggtgtgcgccgctgctgctgttgcctctgtcttcgcgtcaccacagaggcaagacaagggtccatatcgcggcatccggctcccgcccgtcttcaggagagaaagaaaaaataaaatatacttggggaagttgtacctgccagaattagcaagagctttctttaagaagacatttgtcaaactcaacaaattgaaggttaacaccttaagagttgtagttactgaccagaaatatggacagacttcttagacttggaggaggtatgcctggactgggccaggggccacctacagatgctcctgcagtggacacagcagaacaagtctatatctcttccctggcactgttaaaaatgttaaaacatggccgtgctggagttccaatggaagttatgggtttgatgcttggagaatttgttgatgattataccgtcagagtgattgatgtgtttgctatgccacagtcaggaacaggtgtcagtgtggaggcagttgatccagtgttccaagctaaaatgttggatatgttgaagcagacaggaaggccggagatggttgttggttggtatcacagtcaccctggctttggttgttggctttctggtgtggatatcaacactcagcagagctttgaagccttgtcggagagagctgtggcagtggttgtggatcccattcagagtgtaaaaggaaaggttgttattgatgccttcagattgatcaatgctaatatgatggtcttaggacatgaaccaagacaaacaacttcgaatctgggtcacttaaacaagccatctatccaggcattaattcatggactaaacagacattattactccattactattaactatcggaaaaatgaactggaacagaagatgttgctaaatttgcataagaagagttggatggaaggtttgacacttcaggactacagtgaacattgtaaacacaatgaatcagtggtaaaagagatgttggaattagccaagaattacaataaggctgtagaagaagaagataagatgacacctgaacagctggcaataaagaatgttggcaagcaggaccccaaacgtcatttggaggaacatgtggatgtacttatgacctcaaatattgtccagtgtttagcagctatgttggatactgtcgtatttaaataaagcaacgaaaaacgctattaatgatgccttcagtgtatattcctctgttgttcctaatgctcaaaatcaagggacctctgaaggtgtacttggctaaatgtaagacatctggcatcatttgcagcactgtaacaccttcagtctcagttgtgcaattacttctgtttctttagtcagggtctttgcagattctaaagttatacatgaatacatcaaagtggacaaattttgttaagatcccatttaatatttgaaaaaatcagtagcacaaatatattttgattgtcacttacaaaataaaatacatttacagtctaaaaaaaaaaaacaacacaggcattctgtgccaccccacccccgcaactcaccctcccagctgccctccttgccctccgcgcgggaaaccttgcaggcgtctgtctcctcgaccggcgggtaatctactgacgttcgcaaccggaactacgccagcctcgaacattcggtggcgccacctgaatcagctcatcagaacgaggagctcaagctccccccaaaccccccgtatcaacgccatagaccccctcctatctaaagggcacccacttcaatttaattaaatacacgcccccaacccacgcaaag

SEQ ID NO: 437102 - DNA, 2574 bp, Homo sapiens
caattgtgctactcaaatcacagtttggatccaggcgctgtaatctttcctcaccctctgtccagtagattcatcaccattctcgatttaggaatgctttaaagatgcttgttatttggaacatatttgagaaagtgacaggaacgtggcaaacaagctgccttaaacagagactgtacctagacctagagtgtaatatcaacttgtcaagtatatcttctgcaactttgctttttgaaagcctagcacaaagtagatcatgagtaaaatgtgattgccgataattacatggagaaatgtgaataaatgactctttaaaccctgtaaactaaactcggcttaaaataggtggtttgaacatttgggaaaccttagttttccctgaaatccaatccttgcaaagcaataatgacaagaggtggataaagcggacttacagaaaagggcgtcttaccggtcccctctaatcacaccatcccccctcttttaaaaaaattttcttctcagataaccaagttaaatctagctcaaatgaaccttttagtttttgaggagggcaataatagtagtgaacaccaaaacgaaaggggatctgggcttcaaaatactaacagttctatttcctagccagtcgtctcccgggctggatgtgccgccgtcccagatctcagcggcggccgcagagcgcagaggtagggagagaaaaaggaggcgtcggcggggcgcgagcgaccagggcgctaagtgccgcctcacagtcctgccagagacaggagacgccgggccgcccgcgccgtctgtcccaagagctcctcctggacatccgcttgactctccgtcgtctccaattggccgtcggggaacggaagccgaagcaaactagtgaacccggaagtgcttcgcggcggaggcccgggcaactcttttgaatggaatcgggctgattcatcgccggtttgcagactgagccgcgtcgggtgtgcgccgctgctgctgttgcctctgtcttcgcgtcaccacagaggcaagacaagggtccatatcgcggcatccggctcccgcccgtcttcaggagagaaagaaaaaataaaatatacttggggaagttgtacctgccagaattagcaagagctttctttaagaagacatttgtcaaactcaacaaattgaaggttaacaccttaagagttgtagttactgaccagaaatatggacagacttcttagacttggaggaggtatgcctggactgggccagatggagtcttgctctgtcacccaggctagagtgcagtggcatgatcttggctcattgcaacctccacctcctggactcaagagattcttctgcctcagcctcctgagtatcacaggggccacctacagatgctcctgcagtggacacagcagaacaagtctatatctcttccctggcactgttaaaaatgttaaaacatggccgtgctggagttccaatggaagttatgggtttgatgcttggagaatttgttgatgattataccgtcagagtgattgatgtgtttgctatgccacagtcaggaacaggtgtcagtgtggaggcagttgatccagtgttccaagctaaaatgttggatatgttgaagcagacaggaaggccggagatggttgttggttggtatcacagtcaccctggctttggttgttggctttctggtgtggatatcaacactcagcagagctttgaagccttgtcggagagagctgtggcagtggttgtggatcccattcagagtgtaaaaggaaaggttgttattgatgccttcagattgatcaatgctaatatgatggtcttaggacatgaaccaagacaaacaacttcgaatctgggtcacttaaacaagccatctatccaggcattaattcatggactaaacagacattattactccattactattaactatcggaaaaatgaactggaacagaagatgttgctaaatttgcataagaagagttggatggaaggtttgacacttcaggactacagtgaacattgtaaacacaatgaatcagtggtaaaagagatgttggaattagccaagaattacaataaggctgtagaagaagaagataagatgacacctgaacagctggcaataaagaatgttggcaagcaggaccccaaacgtcatttggaggaacatgtggatgtacttatgacctcaaatattgtccagtgtttagcagctatgttggatactgtcgtatttaaataaagcaacgaaaaacgctattaatgatgccttcagtgtatattcctctgttgttcctaatgctcaaaatcaagggacctctgaaggtgtacttggctaaatgtaagacatctggcatcatttgcagcactgtaacaccttcagtctcagttgtgcaattacttctgtttctttagtcagggtctttgcagattctaaagttatacatgaatacatcaaagtggacaaattttgttaagatcccatttaatatttgaaaaaatcagtagcacaaatatattttgattgtcacttacaaaataaaatacatttacagtcta

SEQ ID NO: 437103 - DNA, 1354 bp, Homo sapiens
tcaggagtcgacatactgtccatattgcttggtcactacctacgactcttaaggtgttatcctctaatatgtaattacggatcagagaatatgcgcatcagacttccccatattttcgctggacgtgaatgcctgcgactgcagcgggggccgcctacagtatgctccgtggcttgaacaagtcagaatcggtctagtatctgcttctctgtgagaagttcaaaatgttaaaacatggccgtgctggagttccaatggaagttatgggtttgatgcttggagaatttgttgatgattataccgtcagagtgattgatgtgtttgctatgccacagtcaggaacaggtgtcagtgtggaggcagttgatccagtgttccaagctaaaatgttggatatgttgaagcagacaggaaggccggagatggttgttggttggtatcacagtcaccctggctttggttgttggctttctggtgtggatatcaacactcagcagagctttgaagccttgtcggagagagctgtggcagtggttgtggatcccattcagagtgtaaaaggaaaggttgttattgatgccttcagattgatcaatgctaatatgatggtcttaggacatgaaccaagacaaacaacttcgaatctgggtcacttaaacaagccatctatccaggcattaattcatggactaaacagacattattactccattactattaactatcggaaaaatgaactggaacagaagatgttgctaaatttgcataagaagagttggatggaaggtttgacacttcaggactacagtgaacattgtaaacacaatgaatcagtggtaaaagagatgttggaattagccaagaattacaataaggctgtagaagaagaagataagatgacacctgaacagctggcaataaagaatgttggcaagcaggaccccaaacgtcatttggaggaacatgtggatgtacttatgacctcaaatattgtccagtgtttagcagctatgttggatactgtcgtatttaaataaagcaacgaaaaacgctattaatgatgccttcagtgtatattcctctgttgttcctaatgctcaaaatcaagggacctctgaaggtgtacttggctaaatgtaagacatctggcatcatttgcagcactgtaacaccttcagtctcagttgtgcaattacttctgtttctttagtcagggtctttgcagattctaaagttatacatgaatacatcaaagtggacaaattttgttaagatcccatttaatatttgaaaaaatcagtagcacaaatatattttgattgtcacttacaaaataaaatacatttacagtcta

SEQ ID NO: 437104 - DNA, 1006 bp, Homo sapiens
gagattaggcgtaggtagaagtagaggttaaggagggtgaagatgatatgttgaagcagacaggaaggccggagatggttgttggttggtatcacagtcaccctggctttggttgttggctttctggtgtggatatcaacactcagcagagctttgaagccttgtcggagagagctgtggcagtggttgtggatcccattcagagtgtaaaaggaaaggttgttattgatgccttcagattgatcaatgctaatatgatggtcttaggacatgaaccaagacaaacaacttcgaatctgggtcacttaaacaagccatctatccaggcattaattcatggactaaacagacattattactccattactattaactatcggaaaaatgaactggaacagaagatgttgctaaatttgcataagaagagttggatggaaggtttgacacttcaggactacagtgaacattgtaaacacaatgaatcagtggtaaaagagatgttggaattagccaagaattacaataaggctgtagaagaagaagataagatgacacctgaacagctggcaataaagaatgttggcaagcaggaccccaaacgtcatttggaggaacatgtggatgtacttatgacctcaaatattgtccagtgtttagcagctatgttggatactgtcgtatttaaataaagcaacgaaaaacgctattaatgatgccttcagtgtatattcctctgttgttcctaatgctcaaaatcaagggacctctgaaggtgtacttggctaaatgtaagacatctggcatcatttgcagcactgtaacaccttcagtctcagttgtgcaattacttctgtttctttagtcagggtctttgcagattctaaagttatacatgaatacatcaaagtggacaaattttgttaagatcccatttaatatttgaaaaaatcagtagcacaaatatattttgattgtcacttacaaaataaaatacatttacagtcta

SEQ ID NO: 437105 - DNA, 1845 bp, Homo sapiens
caattgtgctactcaaatcacagtttggatccaggcgctgtaatctttcctcaccctctgtccagtagattcatcaccattctcgatttaggaatgctttaaagatgcttgttatttggaacatatttgagaaagtgacaggaacgtggcaaacaagctgccttaaacagagactgtacctagacctagagtgtaatatcaacttgtcaagtatatcttctgcaactttgctttttgaaagcctagcacaaagtagatcatgagtaaaatgtgattgccgataattacatggagaaatgtgaataaatgactctttaaaccctgtaaactaaactcggcttaaaataggtggtttgaacatttgggaaaccttagttttccctgaaatccaatccttgcaaagcaataatgacaagaggtggataaagcggacttacagaaaagggcgtcttaccggtcccctctaatcacaccatcccccctcttttaaaaaaattttcttctcagataaccaagttaaatctagctcaaatgaaccttttagtttttgaggagggcaataatagtagtgaacaccaaaacgaaaggggatctgggcttcaaaatactaacagttctatttcctagccagtcgtctcccgggctggatgtgccgccgtcccagatctcagcggcggccgcagagcgcagaggtagggagagaaaaaggaggcgtcggcggggcgcgagcgaccagggcgctaagtgccgcctcacagtcctgccagagacaggagacgccgggccgcccgcgccgtctgtcccaagagctcctcctggacatccgcttgactctccgtcgtctccaattggccgtcggggaacggaagccgaagcaaactagtgaacccggaagtgcttcgcggcggaggcccgggcaactcttttgaatggaatcgggctgattcatcgccggtttgcagactgagccgcgtcgggtgtgcgccgctgctgctgttgcctctgtcttcgcgtcaccacagaggcaagacaagggtccatatcgcggcatccggctcccgcccgtcttcaggagagaaagaaaaaataaaatatacttggggaagttgtacctgccagaattagcaagagctttctttaagaagacatttgtcaaactcaacaaattgaaggttaacaccttaagagttgtagttactgaccagaaatatggacagacttcttagacttggaggaggtatgcctggactgggccaggggccacctacagatgctcctgcagtggacacagcagaacaagtctatatctcttccctggcactgttaaaaatgttaaaacatggccgtgctggagttccaatggaagttatgggtttgatgcttggagaatttgttgatgattataccgtcagagtgattgatgtgtttgctatgccacagtcaggaacaggtgtcagtgtggaggcagttgatccagtgttccaagctaaaatgttggatatgttgaagcagacaggaaggccggagatggttgttggttggtatcacagtcaccctggctttggttgttggctttctggtgtggatatcaacactcagcagagctttgaagccttgtcggagagagctgtggcagtggttgtggatcccattcagagtgtaaaaggaaaggttgttattgatgccttcagattgatcaatgctaatatgatggtcttaggacatgaaccaagacaaacaacttcgaatctgggtcacttaaacaagccatctatccaggcattaattcatggactaacagacattatactcccagtgtagagcacagatgcagtcggtatcctc

SEQ ID NO: 437106 - DNA, 10229 bp, Homo sapiens
ggaaactctgaaagaacttagaatcagcattttgagagcagaagcttgggcatgctgtgattttccaataaactgctatcacaatgtcaaaatgcagttcagacaagagcaacacagagatctcaaacattaaaacgtaagctgtgctagaacaaaaatgcaatgaaagaaacactggatgaatgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaagacatttattgctagtactactctactaaagagctgtctctatctagatctaggggagacttcagctagaaatggaaaaaggacggtgttcttggtcaactctgcaaaccaggttgctcaacaagtgtcagctgtcagaactcattcagatctcaaggttggggaatactcaaacctagaagtaaatgcatcttggacaaaagagagatggaaccaagagtttactaagcaccaggttctcattatgacttgctatgtcgccttgaatgttttgaaaaatggttacttatcactgtcagacattaaccttttggtgtttgatgagtgtcatcttgcaatcctagaccacccctatcgagaatttatgaagctctgtgaaatttgtccatcatgtcctcgcattttgggactaactgcttccattttaaatgggaaatgggatccagaggatttggaagaaaagtttcagaaactagagaaaattcttaagagtaatgctgaaactgcaactgacctggtggtcttagacaggtatacttctcagccatgtgagattgtggtggattgtggaccatttactgacagaagtgggctttatgaaagactgctgatggaattagaagaagcacttaattttatcaatgattgtaatatatctgtacattcaaaagaaagagattctactttaatttcgaaacagatactatcagactgtcgtgccgtattggtagttctgggaccctggtgtgcagataaagtagctggaatgatggtaagagaactacagaaatacatcaaacatgagcaagaggagctgcacaggaaatttttattgtttacagacactttcctaaggaaaatacatgcactatgtgaagagcacttctcacctgcctcacttgacctgaaatttgtaactcctaaagtaatcaaactgctcgaaatcttacgcaaatataaaccatatgagcgacacagttttgaaagcgttgagtggtataataatagaaatcaggataattatgtgtcatggagtgattctgaggatgatgatgaggatgaagaaattgaagaaaaagagaagccagagacaaattttccttctccttttaccaacattttgtgcggaattatttttgtggaaagaagatacacagcagttgtcttaaacagattgataaaggaagctggcaaacaagatccagagctggcttatatcagtagcaatttcataactggacatggcattgggaagaatcagcctcgcaacaaacacgatggaagcagaattcagaaaacaggaagaggtacttaggaaatttcgagcacatgagaccaacctgcttattgcaacaagtattgtagaagagggtgttgatataccaaaatgcaacttggtggttcgttttgatttgcccacagaatatcgatcctatgttcaatctaaaggaagagcaagggcacccatctctaattatataatgttagcggatacagacaaaataaaaagttttgaagaagaccttaaaacctacaaagctattgaaaagatcttgagaaacaagtgttccaagtcggttgatactggtgagactgacattgatcctgtcatggatgatgatgacgttttcccaccatatgtgttgaggcctgacgatggtggtccacgagtcacaatcaacacggccattggacacatcaatagatactgtgctagattaccaagtgatccgtttactcatctagctcctaaatgcagaacccgagagttgcctgatggtacattttattcaactctttatctgccaattaactcacctcttcgagcctccattgttggtccaccaatgagctgtgtacgattggctgaaagagttgtagctctcatttgctgtgagaaactgcacaaaattggcgaactggatgaccatttgatgccagttgggaaagagactgttaaatatgaagaggagcttgatttgcatgatgaagaagagaccagtgttccaggaagaccaggttccacgaaacgaaggcagtgctacccaaaagcaattccagagtgtttgagggatagttatcccagacctgatcagccctgttacctgtatgtgataggaatggttttaactacacctttacctgatgaactcaactttagaaggcggaagctctatcctcctgaagataccacaagatgctttggaatactgacggccaaacccatacctcagattccacactttcctgtgtacacacgctctggagaggttaccatatccattgagttgaagaagtctggtttcatgttgtctctacaaatgcttgagttgattacaagacttcaccagtatatattctcacatattcttcggcttgaaaaacctgcactagaatttaaacctacagacgctgattcagcatactgtgttctacctcttaatgttgttaatgactccagcactttggatattgactttaaattcatggaagatattgagaagtctgaagctcgcataggcattcccagtacaaagtatacaaaagaaacaccctttgtttttaaattagaagattaccaagatgccgttatcattccaagatatcgcaattttgatcagcctcatcgattttatgtagctgatgtgtacactgatcttaccccactcagtaaatttccttcccctgagtatgaaacttttgcagaatattataaaacaaagtacaaccttgacctaaccaatctcaaccagccactgctggatgtggaccacacatcttcaagacttaatcttttgacacctcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttagataccctaacttagacttcgggtggaaaaaatctattgacagcaaatctttcatctcaatttctaactcctcttcagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagaatttatacagttacgagaaccagccccagcccagcgatgaatgtactctcctgagtaataaataccttgatggaaatgctaacaaatctacctcagatggaagtcctgtgatggccgtaatgcctggtacgacagacactattcaagtgctcaagggcaggatggattctgagcagagcccttctattgggtactcctcaaggactcttggccccaatcctggacttattcttcaggctttgactctgtcaaacgctagtgatggatttaacctggagcggcttgaaatgcttggcgactcctttttaaagcatgccatcaccacatatctattttgcacttaccctgatgcgcatgagggccgcctttcatatatgagaagcaaaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatgacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactgattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaatagaaaagttttctgcaaatgtaccccgttcccctgtgcgagaattgcttgaaatggaaccagaaactgccaaatttagcccggctgagagaacttacgacgggaaggtcagagtcactgtggaagtagtaggaaaggggaaatttaaaggtgttggtcgaagttacaggattgccaaatctgcagcagcaagaagagccctccgaagcctcaaagctaatcaacctcaggttcccaatagctgaaaccgctttttaaaattcaaaacaagaaacaaaacaaaaaaaattaaggggaaaattatttaaatcggaaaggaagacttaaagttgatagtgagtggaatgaattgaaggcagaatttaaagtttggttgataacaggatagataacagaataaaacatttaacatatgtataaaattttggaactaattgtagttttagttttttgcgcaaacacaatcttatcttctttcctcacttctgctttgtttaaatcacaagagtgctttaatgatgacatttagcaagtgctcaaaataattgacaggttttgtttttttttttttgagtttatgtcagctttgcttagtgttagaaggccatggagcttaaacctccagcagtccctaggatgatgtagattcttctccatctctccgtgtgtgcagtagtgccagtcctgcagtagttgataagctgaatagaaagataaggttttcgagaggagaagtgcgccaatgttgtcttttctttccacgttatactgtgtaaggtgatgttcccggtcgctgttgcacctgatagtaagggacagatttttaatgaacattggctggcatgttggtgaatcacattttagttttctgatgccacatagtcttgcataaaaaagggttcttgccttaaaagtgaaaccttcatggatagtctttaatctctgatctttttggaacaaactgttttacattcctttcattttattatgcattagacgttgagacagcgtgatacttacaactcactagtatagttgtaacttattacaggatcatactaaaatttctgtcatatgtatactgaagacattttaaaaaccagaatatgtagtctacggatattttttatcataaaaatgatctttggctaaacaccccattttactaaagtcctcctgccaggtagttcccactgatggaaatgtttatggcaaataattttgccttctaggctgttgctctaacaaaataaaccttagacatatcacacctaaaatatgctgcagattttataattgattggttacttatttaagaagcaaaacacagcacctttacccttagtctcctcacataaatttcttactatacttttcataatgttgcatgcatatttcacctaccaaagctgtgctgttaatgccgtgaaagtttaacgtttgcgataaactgccgtaattttgatacatctgtgatttaggtcattaatttagataaactagctcattatttccatctttggaaaaggaaaaaaaaaaaaacttctttaggcatttgcctaagtttctttaattagacttgtaggcactcttcacttaaatacctcagttcttcttttcttttgcatgcatttttcccctgtttggtgctatgtttatgtattatgcttgaaattttaattttttttttttttgcactgtaactataatacctcttaatttacctttttaaaagctgtgggtcagtcttgcactcccatcaacataccagtagaggtttgctgcaatttgccccgttaattatgcttgaagtttaagaaagctgagcagaggtgtctcatatttcccagcacatgattctgaacttgatgcttcatggaatgctgcatttatatgtaagtgacatttgaatactgtccttcctgctttatctgcatcatccacccacagagaaatgcctctgtgcgagtgcaccgacagaaaactgtcagctctgctttctaaggaaccctgagtgaggggggtattaagcttctccagtgttttttgttgtctccaatcttaaacttaaattgagatctaaattattaaacgagtttttgagcaaattaggtgacttgttttaaaaatatttaattccgatttggaaccttagatgtctatttgattttttaaaaaaccttaatgtaagatatgaccagttaaaacaaagcaattcttgaattatataactgtaaaagtgtgcagttaacaaggctggatgtgaattttattctgagggtgatttgtgatcaagtttaatcacaaatctcttaatatttataaactacctgatgccaggagcttagggctttgcattgtgtctaatacattgatcccagtgttacgggattctcttgattcctggcaccaaaatcagattgttttcacagttatgattcccagtgggagaaaaatgcctcaatatatttgtaaccttaagaagagtatttttttgttaatactaagatgttcaaacttagacatgattaggtcatacattctcaggggttcaaatttccttctaccattcaaatgttttatcaacagcaaacttcagccgtttcactttttgttggagaaaaatagtagattttaatttgactcacagtttgaagcattctgtgatcccctggttactgagttaaaaaataaaaaagtacgagttagacatatgaaatggttatgaacgcttttgtgctgctgatttttaatgctgtaaagttttcctgtgtttagcttgttgaaatgttttgcatctgtcaattaaggaaaaaaaaaatcactctatgttgccccactttagagccctgtgtgccaccctgtgttcctgtgattgcaatgtgagaccgaatgtaatatggaaaacctaccagtggggtgtggttgtgccctgagcacgtgtgtaaaggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaagaaaatatgcttaacagagaggaaaaaaatgtggtttggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcttttttcttttatattacgtgaagtgatgaaatttagaatgacctctaacactcctgtaattgtcttttaaaatactgatatttttatttgttaataatactttgccctcagaaagattctgataccctgccttgacaacatgaaacttgaggctgctttggttcatgaatccaggtgttcccccggcagtcggcttcttcagtcgctccctggaggcaggtgggcactgcagaggatcactggaatccagatcgagcgcagttcatgcacaaggccccgttgatttaaaatattggatcttgctctgttagggtgtctaatccctttacacaagattgaagccaccaaactgagaccttgatacctttttttaactgcatctgaaattatgttaagagtctttaacccatttgcattatctgcagaagagaaactcatgtcatgtttattacctatatggttgttttaattacatttgaataattatatttttccaaccactgattacttttcaggaatttaattatttccagataaatttctttattttatattgtacatgaaaagttttaaagatatgtttaagaccaagactattaaaatgatttttaaagttgttggagacgccaatagcaatatctaggaaatttgcattgagaccattgtattttccactagcagtgaaaatgatttttcacaactaacttgtaaatatattttaatcattacttctttttttctagtccatttttatttggacatcaaccacagacaatttaaattttatagatgcactaagaattcactgcagcagcaggttacatagcaaaaatgcaaaggtgaacaggaagtaaatttctggcttttctgctgtaaatagtgaaggaaaattactaaaatcaagtaaaactaatgcatattatttgattgacaataaaatatttaccatcacatgctgcagctgttttttaaggaacatgatgtcattcattcatacagtaatcatgctgcagaaatttgcagtctgcaccttatggatcacaattacctttagttgttttttttgtaataattgtagccaagtaaatctccaataaagttatcgtctgttca

SEQ ID NO: 437107 - DNA, 10223 bp, Homo sapiens
  misc_feature (10194)..(10194): n is a, c, g, or t
ggaaactctgaaagaacttagaatcagcattttgagagcagaagcttgggcatgctgtgattttccaataaactgctatcacaatgtcaaaatgcagttcagacaagagcaacacagagatctcaaacattaaaacgtaagctgtgctagaacaaaaatgcaatgaaagaaacactggatgaatgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaagacatttattgctagtactactctactaaagagctgtctctatctagatctaggggagacttcagctagaaatggaaaaaggacggtgttcttggtcaactctgcaaaccaggttgctcaacaagtgtcagctgtcagaactcattcagatctcaaggttggggaatactcaaacctagaagtaaatgcatcttggacaaaagagagatggaaccaagagtttactaagcaccaggttctcattatgacttgctatgtcgccttgaatgttttgaaaaatggttacttatcactgtcagacattaaccttttggtgtttgatgagtgtcatcttgcaatcctagaccacccctatcgagaatttatgaagctctgtgaaatttgtccatcatgtcctcgcattttgggactaactgcttccattttaaatgggaaatgggatccagaggatttggaagaaaagtttcagaaactagagaaaattcttaagagtaatgctgaaactgcaactgacctggtggtcttagacaggtatacttctcagccatgtgagattgtggtggattgtggaccatttactgacagaagtgggctttatgaaagactgctgatggaattagaagaagcacttaattttatcaatgattgtaatatatctgtacattcaaaagaaagagattctactttaatttcgaaacagatactatcagactgtcgtgccgtattggtagttctgggaccctggtgtgcagataaagtagctggaatgatggtaagagaactacagaaatacatcaaacatgagcaagaggagctgcacaggaaatttttattgtttacagacactttcctaaggaaaatacatgcactatgtgaagagcacttctcacctgcctcacttgacctgaaatttgtaactcctaaagtaatcaaactgctcgaaatcttacgcaaatataaaccatatgagcgacacagttttgaaagcgttgagtggtataataatagaaatcaggataattatgtgtcatggagtgattctgaggatgatgatgaggatgaagaaattgaagaaaaagagaagccagagacaaattttccttctccttttaccaacattttgtgcggaattatttttgtggaaagaagatacacagcagttgtcttaaacagattgataaaggaagctggcaaacaagatccagagctggcttatatcagtagcaatttcataactggacatggcattgggaagaatcagcctcgcaacaaacacgatggaagcagaattcagaaaacaggaagaggtacttaggaaatttcgagcacatgagaccaacctgcttattgcaacaagtattgtagaagagggtgttgatataccaaaatgcaacttggtggttcgttttgatttgcccacagaatatcgatcctatgttcaatctaaaggaagagcaagggcacccatctctaattatataatgttagcggatacagacaaaataaaaagttttgaagaagaccttaaaacctacaaagctattgaaaagatcttgagaaacaagtgttccaagtcggttgatactggtgagactgacattgatcctgtcatggatgatgatgacgttttcccaccatatgtgttgaggcctgacgatggtggtccacgagtcacaatcaacacggccattggacacatcaatagatactgtgctagattaccaagtgatccgtttactcatctagctcctaaatgcagaacccgagagttgcctgatggtacattttattcaactctttatctgccaattaactcacctcttcgagcctccattgttggtccaccaatgagctgtgtacgattggctgaaagagttgtagctctcatttgctgtgagaaactgcacaaaattggcgaactggatgaccatttgatgccagttgggaaagagactgttaaatatgaagaggagcttgatttgcatgatgaagaagagaccagtgttccaggaagaccaggttccacgaaacgaaggcagtgctacccaaaagcaattccagagtgtttgagggatagttatcccagacctgatcagccctgttacctgtatgtgataggaatggttttaactacacctttacctgatgaactcaactttagaaggcggaagctctatcctcctgaagataccacaagatgctttggaatactgacggccaaacccatacctcagattccacactttcctgtgtacacacgctctggagaggttaccatatccattgagttgaagaagtctggtttcatgttgtctctacaaatgcttgagttgattacaagacttcaccagtatatattctcacatattcttcggcttgaaaaacctgcactagaatttaaacctacagacgctgattcagcatactgtgttctacctcttaatgttgttaatgactccagcactttggatattgactttaaattcatggaagatattgagaagtctgaagctcgcataggcattcccagtacaaagtatacaaaagaaacaccctttgtttttaaattagaagattaccaagatgccgttatcattccaagatatcgcaattttgatcagcctcatcgattttatgtagctgatgtgtacactgatcttaccccactcagtaaatttccttcccctgagtatgaaacttttgcagaatattataaaacaaagtacaaccttgacctaaccaatctcaaccagccactgctggatgtggaccacacatcttcaagacttaatcttttgacacctcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttagataccctaacttagacttcgggtggaaaaaatctattgacagcaaatctttcatctcaatttctaactcctcttcagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagaatttatacagttacgagaaccagccccagcccagcgatgaatgtactctcctgagtaataaataccttgatggaaatgctaacaaatctacctcagatggaagtcctgtgatggccgtaatgcctggtacgacagacactattcaagtgctcaagggcaggatggattctgagcagagcccttctattgggtactcctcaaggactcttggccccaatcctggacttattcttcaggctttgactctgtcaaacgctagtgatggatttaacctggagcggcttgaaatgcttggcgactcctttttaaagcatgccatcaccacatatctattttgcacttaccctgatgcgcatgagggccgcctttcatatatgagaagcaaaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatgacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactgattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaatagaaaagttttctgcaaatgtaccccgttcccctgtgcgagaattgcttgaaatggaaccagaaactgccaaatttagcccggctgagagaacttacgacgggaaggtcagagtcactgtggaagtagtaggaaaggggaaatttaaaggtgttggtcgaagttacaggattgccaaatctgcagcagcaagaagagccctccgaagcctcaaagctaatcaacctcaggttcccaatagctgaaaccgctttttaaaattcaaaacaagaaacaaaacaaaaaaaattaaggggaaaattatttaaatcggaaaggaagacttaaagttgatagtgagtggaatgaattgaaggcagaatttaaagtttggttgataacaggatagataacagaataaaacatttaacatatgtataaaattttggaactaattgtagttttagttttttgcgcaaacacaatcttatcttctttcctcacttctgctttgtttaaatcacaagagtgctttaatgatgacatttagcaagtgctcaaaataattgacaggttttgtttttttttttttgagtttatgtcagctttgcttagtgttagaaggccatggagcttaaacctccagcagtccctaggatgatgtagattcttctccatctctccgtgtgtgcagtagtgccagtcctgcagtagttgataagctgaatagaaagataaggttttcgagaggagaagtgcgccaatgttgtcttttctttccacgttatactgtgtaaggtgatgttcccggtcgctgttgcacctgatagtaagggacagatttttaatgaacattggctggcatgttggtgaatcacattttagttttctgatgccacatagtcttgcataaaaaagggttcttgccttaaaagtgaaaccttcatggatagtctttaatctctgatctttttggaacaaactgttttacattcctttcattttattatgcattagacgttgagacagcgtgatacttacaactcactagtatagttgtaacttattacaggatcatactaaaatttctgtcatatgtatactgaagacattttaaaaaccagaatatgtagtctacggatattttttatcataaaaatgatctttggctaaacaccccattttactaaagtcctcctgccaggtagttcccactgatggaaatgtttatggcaaataattttgccttctaggctgttgctctaacaaaataaaccttagacatatcacacctaaaatatgctgcagattttataattgattggttacttatttaagaagcaaaacacagcacctttacccttagtctcctcacataaatttcttactatacttttcataatgttgcatgcatatttcacctaccaaagctgtgctgttaatgccgtgaaagtttaacgtttgcgataaactgccgtaattttgatacatctgtgatttaggtcattaatttagataaactagctcattatttccatctttggaaaaggaaaaaaaaaaaaacttctttaggcatttgcctaagtttctttaattagacttgtaggcactcttcacttaaatacctcagttcttcttttcttttgcatgcatttttcccctgtttggtgctatgtttatgtattatgcttgaaattttaattttttttttttttgcactgtaactataatacctcttaatttacctttttaaaagctgtgggtcagtcttgcactcccatcaacataccagtagaggtttgctgcaatttgccccgttaattatgcttgaagtttaagaaagctgagcagaggtgtctcatatttcccagcacatgattctgaacttgatgcttcatggaatgctgcatttatatgtaagtgacatttgaatactgtccttcctgctttatctgcatcatccacccacagagaaatgcctctgtgcgagtgcaccgacagaaaactgtcagctctgctttctaaggaaccctgagtgaggggggtattaagcttctccagtgttttttgttgtctccaatcttaaacttaaattgagatctaaattattaaacgagtttttgagcaaattaggtgacttgttttaaaaatatttaattccgatttggaaccttagatgtctatttgattttttaaaaaaccttaatgtaagatatgaccagttaaaacaaagcaattcttgaattatataactgtaaaagtgtgcagttaacaaggctggatgtgaattttattctgagggtgatttgtgatcaagtttaatcacaaatctcttaatatttataaactacctgatgccaggagcttagggctttgcattgtgtctaatacattgatcccagtgttacgggattctcttgattcctggcaccaaaatcagattgttttcacagttatgattcccagtgggagaaaaatgcctcaatatatttgtaaccttaagaagagtatttttttgttaatactaagatgttcaaacttagacatgattaggtcatacattctcaggggttcaaatttccttctaccattcaaatgttttatcaacagcaaacttcagccgtttcactttttgttggagaaaaatagtagattttaatttgactcacagtttgaagcattctgtgatcccctggttactgagttaaaaaataaaaaagtacgagttagacatatgaaatggttatgaacgcttttgtgctgctgatttttaatgctgtaaagttttcctgtgtttagcttgttgaaatgttttgcatctgtcaattaaggaaaaaaaaaatcactctatgttgccccactttagagccctgtgtgccaccctgtgttcctgtgattgcaatgtgagaccgaatgtaatatggaaaacctaccagtggggtgtggttgtgccctgagcacgtgtgtaaaggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaagaaaatatgcttaacagagaggaaaaaaatgtggtttggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcttttttcttttatattacgtgaagtgatgaaatttagaatgacctctaacactcctgtaattgtcttttaaaatactgatatttttatttgttaataatactttgccctcagaaagattctgataccctgccttgacaacatgaaacttgaggctgctttggttcatgaatccaggtgttcccccggcagtcggcttcttcagtcgctccctggaggcaggtgggcactgcagaggatcactggaatccagatcgagcgcagttcatgcacaaggccccgttgatttaaaatattggatcttgctctgttagggtgtctaatccctttacacaagattgaagccaccaaactgagaccttgatacctttttttaactgcatctgaaattatgttaagagtctttaacccatttgcattatctgcagaagagaaactcatgtcatgtttattacctatatggttgttttaattacatttgaataattatatttttccaaccactgattacttttcaggaatttaattatttccagataaatttctttattttatattgtacatgaaaagttttaaagatatgtttaagaccaagactattaaaatgatttttaaagttgttggagacgccaatagcaatatctaggaaatttgcattgagaccattgtattttccactagcagtgaaaatgatttttcacaactaacttgtaaatatattttaatcattacttctttttttctagtccatttttatttggacatcaaccacagacaatttaaattttatagatgcactaagaattcactgcagcagcaggttacatagcaaaaatgcaaaggtgaacaggaagtaaatttctggcttttctgctgtaaatagtgaaggaaaattactaaaatcaagtaaaactaatgcatattatttgattgacaataaaatatttaccatcacatgctgcagctgttttttaaggaacatgatgtcattcattcatacagtaatcatgctgcagaaatttgcagtctgcaccttagaacacatggcttagtgattttcgaaaaacacccgcaggggggnaaataagtcgtccaacaaagcacaacatt

SEQ ID NO: 437108 - DNA, 10175 bp, Homo sapiens
ggaaactctgaaagaacttagaatcagcattttgagagcagaagcttgggcatgctgtgattttccaataaactgctatcacaatgtcaaaatgcagttcagacaagagcaacacagagatctcaaacattaaaacgtaagctgtgctagaacaaaaatgcaatgaaagaaacactggatgaatgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaagacatttattgctagtactactctactaaagagctgtctctatctagatctaggggagacttcagctagaaatggaaaaaggacggtgttcttggtcaactctgcaaaccaggttgctcaacaagtgtcagctgtcagaactcattcagatctcaaggttggggaatactcaaacctagaagtaaatgcatcttggacaaaagagagatggaaccaagagtttactaagcaccaggttctcattatgacttgctatgtcgccttgaatgttttgaaaaatggttacttatcactgtcagacattaaccttttggtgtttgatgagtgtcatcttgcaatcctagaccacccctatcgagaatttatgaagctctgtgaaatttgtccatcatgtcctcgcattttgggactaactgcttccattttaaatgggaaatgggatccagaggatttggaagaaaagtttcagaaactagagaaaattcttaagagtaatgctgaaactgcaactgacctggtggtcttagacaggtatacttctcagccatgtgagattgtggtggattgtggaccatttactgacagaagtgggctttatgaaagactgctgatggaattagaagaagcacttaattttatcaatgattgtaatatatctgtacattcaaaagaaagagattctactttaatttcgaaacagatactatcagactgtcgtgccgtattggtagttctgggaccctggtgtgcagataaagtagctggaatgatggtaagagaactacagaaatacatcaaacatgagcaagaggagctgcacaggaaatttttattgtttacagacactttcctaaggaaaatacatgcactatgtgaagagcacttctcacctgcctcacttgacctgaaatttgtaactcctaaagtaatcaaactgctcgaaatcttacgcaaatataaaccatatgagcgacacagttttgaaagcgttgagtggtataataatagaaatcaggataattatgtgtcatggagtgattctgaggatgatgatgaggatgaagaaattgaagaaaaagagaagccagagacaaattttccttctccttttaccaacattttgtgcggaattatttttgtggaaagaagatacacagcagttgtcttaaacagattgataaaggaagctggcaaacaagatccagagctggcttatatcagtagcaatttcataactggacatggcattgggaagaatcagcctcgcaacaaacacgatggaagcagaattcagaaaacaggaagaggtacttaggaaatttcgagcacatgagaccaacctgcttattgcaacaagtattgtagaagagggtgttgatataccaaaatgcaacttggtggttcgttttgatttgcccacagaatatcgatcctatgttcaatctaaaggaagagcaagggcacccatctctaattatataatgttagcggatacagacaaaataaaaagttttgaagaagaccttaaaacctacaaagctattgaaaagatcttgagaaacaagtgttccaagtcggttgatactggtgagactgacattgatcctgtcatggatgatgatgacgttttcccaccatatgtgttgaggcctgacgatggtggtccacgagtcacaatcaacacggccattggacacatcaatagatactgtgctagattaccaagtgatccgtttactcatctagctcctaaatgcagaacccgagagttgcctgatggtacattttattcaactctttatctgccaattaactcacctcttcgagcctccattgttggtccaccaatgagctgtgtacgattggctgaaagagttgtagctctcatttgctgtgagaaactgcacaaaattggcgaactggatgaccatttgatgccagttgggaaagagactgttaaatatgaagaggagcttgatttgcatgatgaagaagagaccagtgttccaggaagaccaggttccacgaaacgaaggcagtgctacccaaaagcaattccagagtgtttgagggatagttatcccagacctgatcagccctgttacctgtatgtgataggaatggttttaactacacctttacctgatgaactcaactttagaaggcggaagctctatcctcctgaagataccacaagatgctttggaatactgacggccaaacccatacctcagattccacactttcctgtgtacacacgctctggagaggttaccatatccattgagttgaagaagtctggtttcatgttgtctctacaaatgcttgagttgattacaagacttcaccagtatatattctcacatattcttcggcttgaaaaacctgcactagaatttaaacctacagacgctgattcagcatactgtgttctacctcttaatgttgttaatgactccagcactttggatattgactttaaattcatggaagatattgagaagtctgaagctcgcataggcattcccagtacaaagtatacaaaagaaacaccctttgtttttaaattagaagattaccaagatgccgttatcattccaagatatcgcaattttgatcagcctcatcgattttatgtagctgatgtgtacactgatcttaccccactcagtaaatttccttcccctgagtatgaaacttttgcagaatattataaaacaaagtacaaccttgacctaaccaatctcaaccagccactgctggatgtggaccacacatcttcaagacttaatcttttgacacctcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttagataccctaacttagacttcgggtggaaaaaatctattgacagcaaatctttcatctcaatttctaactcctcttcagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagaatttatacagttacgagaaccagccccagcccagcgatgaatgtactctcctgagtaataaataccttgatggaaatgctaacaaatctacctcagatggaagtcctgtgatggccgtaatgcctggtacgacagacactattcaagtgctcaagggcaggatggattctgagcagagcccttctattgggtactcctcaaggactcttggccccaatcctggacttattcttcaggctttgactctgtcaaacgctagtgatggatttaacctggagcggcttgaaatgcttggcgactcctttttaaagcatgccatcaccacatatctattttgcacttaccctgatgcgcatgagggccgcctttcatatatgagaagcaaaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatgacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactgattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaatagaaaagttttctgcaaatgtaccccgttcccctgtgcgagaattgcttgaaatggaaccagaaactgccaaatttagcccggctgagagaacttacgacgggaaggtcagagtcactgtggaagtagtaggaaaggggaaatttaaaggtgttggtcgaagttacaggattgccaaatctgcagcagcaagaagagccctccgaagcctcaaagctaatcaacctcaggttcccaatagctgaaaccgctttttaaaattcaaaacaagaaacaaaacaaaaaaaattaaggggaaaattatttaaatcggaaaggaagacttaaagttgatagtgagtggaatgaattgaaggcagaatttaaagtttggttgataacaggatagataacagaataaaacatttaacatatgtataaaattttggaactaattgtagttttagttttttgcgcaaacacaatcttatcttctttcctcacttctgctttgtttaaatcacaagagtgctttaatgatgacatttagcaagtgctcaaaataattgacaggttttgtttttttttttttgagtttatgtcagctttgcttagtgttagaaggccatggagcttaaacctccagcagtccctaggatgatgtagattcttctccatctctccgtgtgtgcagtagtgccagtcctgcagtagttgataagctgaatagaaagataaggttttcgagaggagaagtgcgccaatgttgtcttttctttccacgttatactgtgtaaggtgatgttcccggtcgctgttgcacctgatagtaagggacagatttttaatgaacattggctggcatgttggtgaatcacattttagttttctgatgccacatagtcttgcataaaaaagggttcttgccttaaaagtgaaaccttcatggatagtctttaatctctgatctttttggaacaaactgttttacattcctttcattttattatgcattagacgttgagacagcgtgatacttacaactcactagtatagttgtaacttattacaggatcatactaaaatttctgtcatatgtatactgaagacattttaaaaaccagaatatgtagtctacggatattttttatcataaaaatgatctttggctaaacaccccattttactaaagtcctcctgccaggtagttcccactgatggaaatgtttatggcaaataattttgccttctaggctgttgctctaacaaaataaaccttagacatatcacacctaaaatatgctgcagattttataattgattggttacttatttaagaagcaaaacacagcacctttacccttagtctcctcacataaatttcttactatacttttcataatgttgcatgcatatttcacctaccaaagctgtgctgttaatgccgtgaaagtttaacgtttgcgataaactgccgtaattttgatacatctgtgatttaggtcattaatttagataaactagctcattatttccatctttggaaaaggaaaaaaaaaaaaacttctttaggcatttgcctaagtttctttaattagacttgtaggcactcttcacttaaatacctcagttcttcttttcttttgcatgcatttttcccctgtttggtgctatgtttatgtattatgcttgaaattttaattttttttttttttgcactgtaactataatacctcttaatttacctttttaaaagctgtgggtcagtcttgcactcccatcaacataccagtagaggtttgctgcaatttgccccgttaattatgcttgaagtttaagaaagctgagcagaggtgtctcatatttcccagcacatgattctgaacttgatgcttcatggaatgctgcatttatatgtaagtgacatttgaatactgtccttcctgctttatctgcatcatccacccacagagaaatgcctctgtgcgagtgcaccgacagaaaactgtcagctctgctttctaaggaaccctgagtgaggggggtattaagcttctccagtgttttttgttgtctccaatcttaaacttaaattgagatctaaattattaaacgagtttttgagcaaattaggtgacttgttttaaaaatatttaattccgatttggaaccttagatgtctatttgattttttaaaaaaccttaatgtaagatatgaccagttaaaacaaagcaattcttgaattatataactgtaaaagtgtgcagttaacaaggctggatgtgaattttattctgagggtgatttgtgatcaagtttaatcacaaatctcttaatatttataaactacctgatgccaggagcttagggctttgcattgtgtctaatacattgatcccagtgttacgggattctcttgattcctggcaccaaaatcagattgttttcacagttatgattcccagtgggagaaaaatgcctcaatatatttgtaaccttaagaagagtatttttttgttaatactaagatgttcaaacttagacatgattaggtcatacattctcaggggttcaaatttccttctaccattcaaatgttttatcaacagcaaacttcagccgtttcactttttgttggagaaaaatagtagattttaatttgactcacagtttgaagcattctgtgatcccctggttactgagttaaaaaataaaaaagtacgagttagacatatgaaatggttatgaacgcttttgtgctgctgatttttaatgctgtaaagttttcctgtgtttagcttgttgaaatgttttgcatctgtcaattaaggaaaaaaaaaatcactctatgttgccccactttagagccctgtgtgccaccctgtgttcctgtgattgcaatgtgagaccgaatgtaatatggaaaacctaccagtggggtgtggttgtgccctgagcacgtgtgtaaaggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaagaaaatatgcttaacagagaggaaaaaaatgtggtttggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcttttttcttttatattacgtgaagtgatgaaatttagaatgacctctaacactcctgtaattgtcttttaaaatactgatatttttatttgttaataatactttgccctcagaaagattctgataccctgccttgacaacatgaaacttgaggctgctttggttcatgaatccaggtgttcccccggcagtcggcttcttcagtcgctccctggaggcaggtgggcactgcagaggatcactggaatccagatcgagcgcagttcatgcacaaggccccgttgatttaaaatattggatcttgctctgttagggtgtctaatccctttacacaagattgaagccaccaaactgagaccttgatacctttttttaactgcatctgaaattatgttaagagtctttaacccatttgcattatctgcagaagagaaactcatgtcatgtttattacctatatggttgttttaattacatttgaataattatatttttccaaccactgattacttttcaggaatttaattatttccagataaatttctttattttatattgtacatgaaaagttttaaagatatgtttaagaccaagactattattgagaccattgtattttccactagcagtgaaaatgatttttcacaactaacttgtaaatatattttaatcattacttctttttttctagtccatttttatttggacatcaaccacagacaatttaaattttatagatgcactaagaattcactgcagcagcaggttacatagcaaaaatgcaaaggtgaacaggaagtaaatttctggcttttctgctgtaaatagtgaaggaaaattactaaaatcaagtaaaactaatgcatattatttgattgacaataaaatatttaccatcacatgctgcagctgttttttaaggaacatgatgtcattcattcatacagtaatcatgctgcagaaatttgcagtctgcaccttatggatcacaattacctttagttgttttttttgtaataattgtagccaagtaaatctccaataaagttatcgtctgttca

SEQ ID NO: 437109 - DNA, 10023 bp, Homo sapiens
ggaaactctgaaagaacttagaatcagcattttgagagcagaagcttgggcatgctgtgattttccaataaactgctatcacaatgtcaaaatgcagttcagacaagagcaacacagagatctcaaacattaaaacgtaagctgtgctagaacaaaaatgcaatgaaagaaacactggatgaatgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaagacatttattgctagtactactctactaaagagctgtctctatctagatctaggggagacttcagctagaaatggaaaaaggacggtgttcttggtcaactctgcaaaccaggttgctcaacaagtgtcagctgtcagaactcattcagatctcaaggttggggaatactcaaacctagaagtaaatgcatcttggacaaaagagagatggaaccaagagtttactaagcaccaggttctcattatgacttgctatgtcgccttgaatgttttgaaaaatggttacttatcactgtcagacattaaccttttggtgtttgatgagtgtcatcttgcaatcctagaccacccctatcgagaatttatgaagctctgtgaaatttgtccatcatgtcctcgcattttgggactaactgcttccattttaaatgggaaatgggatccagaggatttggaagaaaagtttcagaaactagagaaaattcttaagagtaatgctgaaactgcaactgacctggtggtcttagacaggtatacttctcagccatgtgagattgtggtggattgtggaccatttactgacagaagtgggctttatgaaagactgctgatggaattagaagaagcacttaattttatcaatgattgtaatatatctgtacattcaaaagaaagagattctactttaatttcgaaacagatactatcagactgtcgtgccgtattggtagttctgggaccctggtgtgcagataaagtagctggaatgatggtaagagaactacagaaatacatcaaacatgagcaagaggagctgcacaggaaatttttattgtttacagacactttcctaaggaaaatacatgcactatgtgaagagcacttctcacctgcctcacttgacctgaaatttgtaactcctaaagtaatcaaactgctcgaaatcttacgcaaatataaaccatatgagcgacacagttttgaaagcgttgagtggtataataatagaaatcaggataattatgtgtcatggagtgattctgaggatgatgatgaggatgaagaaattgaagaaaaagagaagccagagacaaattttccttctccttttaccaacattttgtgcggaattatttttgtggaaagaagatacacagcagttgtcttaaacagattgataaaggaagctggcaaacaagatccagagctggcttatatcagtagcaatttcataactggacatggcattgggaagaatcagcctcgcaacaaacacgatggaagcagaattcagaaaacaggaagaggtacttaggaaatttcgagcacatgagaccaacctgcttattgcaacaagtattgtagaagagggtgttgatataccaaaatgcaacttggtggttcgttttgatttgcccacagaatatcgatcctatgttcaatctaaaggaagagcaagggcacccatctctaattatataatgttagcggatacagacaaaataaaaagttttgaagaagaccttaaaacctacaaagctattgaaaagatcttgagaaacaagtgttccaagtcggttgatactggtgagactgacattgatcctgtcatggatgatgatgacgttttcccaccatatgtgttgaggcctgacgatggtggtccacgagtcacaatcaacacggccattggacacatcaatagatactgtgctagattaccaagtgatccgtttactcatctagctcctaaatgcagaacccgagagttgcctgatggtacattttattcaactctttatctgccaattaactcacctcttcgagcctccattgttggtccaccaatgagctgtgtacgattggctgaaagagttgtagctctcatttgctgtgagaaactgcacaaaattggcgaactggatgaccatttgatgccagttgggaaagagactgttaaatatgaagaggagcttgatttgcatgatgaagaagagaccagtgttccaggaagaccaggttccacgaaacgaaggcagtgctacccaaaagcaattccagagtgtttgagggatagttatcccagacctgatcagccctgttacctgtatgtgataggaatggttttaactacacctttacctgatgaactcaactttagaaggcggaagctctatcctcctgaagataccacaagatgctttggaatactgacggccaaacccatacctcagattccacactttcctgtgtacacacgctctggagaggttaccatatccattgagttgaagaagtctggtttcatgttgtctctacaaatgcttgagttgattacaagacttcaccagtatatattctcacatattcttcggcttgaaaaacctgcactagaatttaaacctacagacgctgattcagcatactgtgttctacctcttaatgttgttaatgactccagcactttggatattgactttaaattcatggaagatattgagaagtctgaagctcgcataggcattcccagtacaaagtatacaaaagaaacaccctttgtttttaaattagaagattaccaagatgccgttatcattccaagatatcgcaattttgatcagcctcatcgattttatgtagctgatgtgtacactgatcttaccccactcagtaaatttccttcccctgagtatgaaacttttgcagaatattataaaacaaagtacaaccttgacctaaccaatctcaaccagccactgctggatgtggaccacacatcttcaagacttaatcttttgacacctcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttagataccctaacttagacttcgggtggaaaaaatctattgacagcaaatctttcatctcaatttctaactcctcttcagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagaatttatacagttacgagaaccagccccagcccagcgatgaatgtactctcctgagtaataaataccttgatggaaatgctaacaaatctacctcagatggaagtcctgtgatggccgtaatgcctggtacgacagacactattcaagtgctcaagggcaggatggattctgagcagagcccttctattgggtactcctcaaggactcttggccccaatcctggacttattcttcaggctttgactctgtcaaacgctagtgatggatttaacctggagcggcttgaaatgcttggcgactcctttttaaagcatgccatcaccacatatctattttgcacttaccctgatgcgcatgagggccgcctttcatatatgagaagcaaaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatgacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactgattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaatagaaaagttttctgcaaatgtaccccgttcccctgtgcgagaattgcttgaaatggaaccagaaactgccaaatttagcccggctgagagaacttacgacgggaaggtcagagtcactgtggaagtagtaggaaaggggaaatttaaaggtgttggtcgaagttacaggattgccaaatctgcagcagcaagaagagccctccgaagcctcaaagctaatcaacctcaggttcccaatagctgaaaccgctttttaaaattcaaaacaagaaacaaaacaaaaaaaattaaggggaaaattatttaaatcggaaaggaagacttaaagttgatagtgagtggaatgaattgaaggcagaatttaaagtttggttgataacaggatagataacagaataaaacatttaacatatgtataaaattttggaactaattgtagttttagttttttgcgcaaacacaatcttatcttctttcctcacttctgctttgtttaaatcacaagagtgctttaatgatgacatttagcaagtgctcaaaataattgacaggttttgtttttttttttttgagtttatgtcagctttgcttagtgttagaaggccatggagcttaaacctccagcagtccctaggatgatgtagattcttctccatctctccgtgtgtgcagtagtgccagtcctgcagtagttgataagctgaatagaaagataaggttttcgagaggagaagtgcgccaatgttgtcttttctttccacgttatactgtgtaaggtgatgttcccggtcgctgttgcacctgatagtaagggacagatttttaatgaacattggctggcatgttggtgaatcacattttagttttctgatgccacatagtcttgcataaaaaagggttcttgccttaaaagtgaaaccttcatggatagtctttaatctctgatctttttggaacaaactgttttacattcctttcattttattatgcattagacgttgagacagcgtgatacttacaactcactagtatagttgtaacttattacaggatcatactaaaatttctgtcatatgtatactgaagacattttaaaaaccagaatatgtagtctacggatattttttatcataaaaatgatctttggctaaacaccccattttactaaagtcctcctgccaggtagttcccactgatggaaatgtttatggcaaataattttgccttctaggctgttgctctaacaaaataaaccttagacatatcacacctaaaatatgctgcagattttataattgattggttacttatttaagaagcaaaacacagcacctttacccttagtctcctcacataaatttcttactatacttttcataatgttgcatgcatatttcacctaccaaagctgtgctgttaatgccgtgaaagtttaacgtttgcgataaactgccgtaattttgatacatctgtgatttaggtcattaatttagataaactagctcattatttccatctttggaaaaggaaaaaaaaaaaaacttctttaggcatttgcctaagtttctttaattagacttgtaggcactcttcacttaaatacctcagttcttcttttcttttgcatgcatttttcccctgtttggtgctatgtttatgtattatgcttgaaattttaattttttttttttttgcactgtaactataatacctcttaatttacctttttaaaagctgtgggtcagtcttgcactcccatcaacataccagtagaggtttgctgcaatttgccccgttaattatgcttgaagtttaagaaagctgagcagaggtgtctcatatttcccagcacatgattctgaacttgatgcttcatggaatgctgcatttatatgtaagtgacatttgaatactgtccttcctgctttatctgcatcatccacccacagagaaatgcctctgtgcgagtgcaccgacagaaaactgtcagctctgctttctaaggaaccctgagtgaggggggtattaagcttctccagtgttttttgttgtctccaatcttaaacttaaattgagatctaaattattaaacgagtttttgagcaaattaggtgacttgttttaaaaatatttaattccgatttggaaccttagatgtctatttgattttttaaaaaaccttaatgtaagatatgaccagttaaaacaaagcaattcttgaattatataactgtaaaagtgtgcagttaacaaggctggatgtgaattttattctgagggtgatttgtgatcaagtttaatcacaaatctcttaatatttataaactacctgatgccaggagcttagggctttgcattgtgtctaatacattgatcccagtgttacgggattctcttgattcctggcaccaaaatcagattgttttcacagttatgattcccagtgggagaaaaatgcctcaatatatttgtaaccttaagaagagtatttttttgttaatactaagatgttcaaacttagacatgattaggtcatacattctcaggggttcaaatttccttctaccattcaaatgttttatcaacagcaaacttcagccgtttcactttttgttggagaaaaatagtagattttaatttgactcacagtttgaagcattctgtgatcccctggttactgagttaaaaaataaaaaagtacgagttagacatatgaaatggttatgaacgcttttgtgctgctgatttttaatgctgtaaagttttcctgtgtttagcttgttgaaatgttttgcatctgtcaattaaggaaaaaaaaaatcactctatgttgccccactttagagccctgtgtgccaccctgtgttcctgtgattgcaatgtgagaccgaatgtaatatggaaaacctaccagtggggtgtggttgtgccctgagcacgtgtgtaaaggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaagaaaatatgcttaacagagaggaaaaaaatgtggtttggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcttttttcttttatattacgtgaagtgatgaaatttagaatgacctctaacactcctgtaattgtcttttaaaatactgatatttttatttgttaataatactttgccctcagaaagattctgataccctgccttgacaacatgaaacttgaggctgctttggttcatgaatccaggtgttcccccggcagtcggcttcttcagtcgctccctggaggcaggtgggcactgcagaggatcactggaatccagatcgagcgcagttcatgcacaaggccccgttgatttaaaatattggatcttgctctgttagggtgtctaatccctttacacaagattgaagccaccaaactgagaccttgatacctttttttaactgcatctgaaattatgttaagagtctttaacccatttgcattatctgcagaagagaaactcatgtcatgtttattacctatatggttgttttaattacatttgaataattatatttttccaaccactgattacttttcaggaatttaattatttccagataaatttctttattttatattgtacatgaaaagttttaaagatatgtttaagaccaagactattaaaatgatttttaaagttgttggagacgccaatagcaatatctaggaaatttgcattgagaccattgtattttccactagcagtgaaaatgatttttcacaactaacttgtaaatatattttaatcattacttctttttttctagtccatttttatttggacatcaaccacagacaaggtagagccgagctcggctctaccttgtctcggctctaccttgtctctcggctctaccttgctctagtcatatcccaccaccagtaccaagtgaattcaatgatgtttccctgtacacacatctgaaacaag

SEQ ID NO: 437110 - DNA, 8196 bp, Homo sapiens
ctcaatcctgctcctgtataagtggacccattttctatggccattttatttagcattgatatgtggtgatgtcatgtttagatgtttttgtttctgaaccttagaacagaatttgcagtccagctcatattggaatatatggatgccaaaatagactttgcctgaagtgtgaatctgattacttttaaattgtaaaaggcaaaggtgctttagtttccattacttttccaggtccttctaacatagttctgttctaaattctttactaattaatcaggcaaaatctggattgtgttaattctctctttaaatttgttaggcgaactggatgaccatttgatgccagttgggaaagagactgttaaatatgaagaggagcttgatttgcatgatgaagaagagaccagtgttccaggaagaccaggttccacgaaacgaaggcagtgctacccaaaagcattacctgtatgtgataggaatggttttaactacacctttacctgatgaactcaactttagaaggcggaagctctatcctcctgaagataccacaagatgctttggaatactgacggccaaacccatacctcagattccacactttcctgtgtacacacgctctggagaggttaccatatccattgagttgaagaagtctggtttcatgttgtctctacaaatgcttgagttgattacaagacttcaccagtatatattctcacatattcttcggcttgaaaaacctgcactagaatttaaacctacagacgctgattcagcatactgtgttctacctcttaatgttgttaatgactccagcactttggatattgactttaaattcatggaagatattgagaagtctgaagctcgcataggcattcccagtacaaagtatacaaaagaaacaccctttgtttttaaattagaagattaccaagatgccgttatcattccaagatatcgcaattttgatcagcctcatcgattttatgtagctgatgtgtacactgatcttaccccactcagtaaatttccttcccctgagtatgaaacttttgcagaatattataaaacaaagtacaaccttgacctaaccaatctcaaccagccactgctggatgtggaccacacatcttcaagacttaatcttttgacacctcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttagataccctaacttagacttcgggtggaaaaaatctattgacagcaaatctttcatctcaatttctaactcctcttcagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagaatttatacagttacgagaaccagccccagcccagcgatgaatgtactctcctgagtaataaataccttgatggaaatgctaacaaatctacctcagatggaagtcctgtgatggccgtaatgcctggtacgacagacactattcaagtgctcaagggcaggatggattctgagcagagcccttctattgggtactcctcaaggactcttggccccaatcctggacttattcttcaggctttgactctgtcaaacgctagtgatggatttaacctggagcggcttgaaatgcttggcgactcctttttaaagcatgccatcaccacatatctattttgcacttaccctgatgcgcatgagggccgcctttcatatatgagaagcaaaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatgacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactgattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaatagaaaagttttctgcaaatgtaccccgttcccctgtgcgagaattgcttgaaatggaaccagaaactgccaaatttagcccggctgagagaacttacgacgggaaggtcagagtcactgtggaagtagtaggaaaggggaaatttaaaggtgttggtcgaagttacaggattgccaaatctgcagcagcaagaagagccctccgaagcctcaaagctaatcaacctcaggttcccaatagctgaaaccgctttttaaaattcaaaacaagaaacaaaacaaaaaaaattaaggggaaaattatttaaatcggaaaggaagacttaaagttgatagtgagtggaatgaattgaaggcagaatttaaagtttggttgataacaggatagataacagaataaaacatttaacatatgtataaaattttggaactaattgtagttttagttttttgcgcaaacacaatcttatcttctttcctcacttctgctttgtttaaatcacaagagtgctttaatgatgacatttagcaagtgctcaaaataattgacaggttttgtttttttttttttgagtttatgtcagctttgcttagtgttagaaggccatggagcttaaacctccagcagtccctaggatgatgtagattcttctccatctctccgtgtgtgcagtagtgccagtcctgcagtagttgataagctgaatagaaagataaggttttcgagaggagaagtgcgccaatgttgtcttttctttccacgttatactgtgtaaggtgatgttcccggtcgctgttgcacctgatagtaagggacagatttttaatgaacattggctggcatgttggtgaatcacattttagttttctgatgccacatagtcttgcataaaaaagggttcttgccttaaaagtgaaaccttcatggatagtctttaatctctgatctttttggaacaaactgttttacattcctttcattttattatgcattagacgttgagacagcgtgatacttacaactcactagtatagttgtaacttattacaggatcatactaaaatttctgtcatatgtatactgaagacattttaaaaaccagaatatgtagtctacggatattttttatcataaaaatgatctttggctaaacaccccattttactaaagtcctcctgccaggtagttcccactgatggaaatgtttatggcaaataattttgccttctaggctgttgctctaacaaaataaaccttagacatatcacacctaaaatatgctgcagattttataattgattggttacttatttaagaagcaaaacacagcacctttacccttagtctcctcacataaatttcttactatacttttcataatgttgcatgcatatttcacctaccaaagctgtgctgttaatgccgtgaaagtttaacgtttgcgataaactgccgtaattttgatacatctgtgatttaggtcattaatttagataaactagctcattatttccatctttggaaaaggaaaaaaaaaaaaacttctttaggcatttgcctaagtttctttaattagacttgtaggcactcttcacttaaatacctcagttcttcttttcttttgcatgcatttttcccctgtttggtgctatgtttatgtattatgcttgaaattttaattttttttttttttgcactgtaactataatacctcttaatttacctttttaaaagctgtgggtcagtcttgcactcccatcaacataccagtagaggtttgctgcaatttgccccgttaattatgcttgaagtttaagaaagctgagcagaggtgtctcatatttcccagcacatgattctgaacttgatgcttcatggaatgctgcatttatatgtaagtgacatttgaatactgtccttcctgctttatctgcatcatccacccacagagaaatgcctctgtgcgagtgcaccgacagaaaactgtcagctctgctttctaaggaaccctgagtgaggggggtattaagcttctccagtgttttttgttgtctccaatcttaaacttaaattgagatctaaattattaaacgagtttttgagcaaattaggtgacttgttttaaaaatatttaattccgatttggaaccttagatgtctatttgattttttaaaaaaccttaatgtaagatatgaccagttaaaacaaagcaattcttgaattatataactgtaaaagtgtgcagttaacaaggctggatgtgaattttattctgagggtgatttgtgatcaagtttaatcacaaatctcttaatatttataaactacctgatgccaggagcttagggctttgcattgtgtctaatacattgatcccagtgttacgggattctcttgattcctggcaccaaaatcagattgttttcacagttatgattcccagtgggagaaaaatgcctcaatatatttgtaaccttaagaagagtatttttttgttaatactaagatgttcaaacttagacatgattaggtcatacattctcaggggttcaaatttccttctaccattcaaatgttttatcaacagcaaacttcagccgtttcactttttgttggagaaaaatagtagattttaatttgactcacagtttgaagcattctgtgatcccctggttactgagttaaaaaataaaaaagtacgagttagacatatgaaatggttatgaacgcttttgtgctgctgatttttaatgctgtaaagttttcctgtgtttagcttgttgaaatgttttgcatctgtcaattaaggaaaaaaaaaatcactctatgttgccccactttagagccctgtgtgccaccctgtgttcctgtgattgcaatgtgagaccgaatgtaatatggaaaacctaccagtggggtgtggttgtgccctgagcacgtgtgtaaaggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaagaaaatatgcttaacagagaggaaaaaaatgtggtttggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcttttttcttttatattacgtgaagtgatgaaatttagaatgacctctaacactcctgtaattgtcttttaaaatactgatatttttatttgttaataatactttgccctcagaaagattctgataccctgccttgacaacatgaaacttgaggctgctttggttcatgaatccaggtgttcccccggcagtcggcttcttcagtcgctccctggaggcaggtgggcactgcagaggatcactggaatccagatcgagcgcagttcatgcacaaggccccgttgatttaaaatattggatcttgctctgttagggtgtctaatccctttacacaagattgaagccaccaaactgagaccttgatacctttttttaactgcatctgaaattatgttaagagtctttaacccatttgcattatctgcagaagagaaactcatgtcatgtttattacctatatggttgttttaattacatttgaataattatatttttccaaccactgattacttttcaggaatttaattatttccagataaatttctttattttatattgtacatgaaaagttttaaagatatgtttaagaccaagactattaaaatgatttttaaagttgttggagacgccaatagcaatatctaggaaatttgcattgagaccattgtattttccactagcagtgaaaatgatttttcacaactaacttgtaaatatattttaatcattacttctttttttctagtccatttttatttggacatcaaccacagacaatttaaattttatagatgcactaagaattcactgcagcagcaggttacatagcaaaaatgcaaaggtgaacaggaagtaaatttctggcttttctgctgtaaatagtgaaggaaaattactaaaatcaagtaaaactaatgcatattatttgattgacaataaaatatttaccatcacatgctgcagctgttttttaaggaacatgatgtcattcattcatacagtaatcatgctgcagaaatttgcagtctgcaccttatggatcacaattacctttagttgttttttttgtaataattgtagccaagtaaatctccaataaagttatcgtctgttca

SEQ ID NO: 437111 - DNA, 10599 bp, Homo sapiens
ggaaactctgaaagaacttagaatcagcattttgagagcagaagcttgggcatgctgtgattttccaataaactgctatcacaatgtcaaaatgcagttcagacaagagcaacacagagatctcaaacattaaaacgtaagctgtgctagaacaaaaatgcaatgaaagaaacactggatgaatgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaagacatttattgctagtactactctactaaagagctgtctctatctagatctaggggagacttcagctagaaatggaaaaaggacggtgttcttggtcaactctgcaaaccaggttgctcaacaagtgtcagctgtcagaactcattcagatctcaaggttggggaatactcaaacctagaagtaaatgcatcttggacaaaagagagatggaaccaagagtttactaagcaccaggttctcattatgacttgctatgtcgccttgaatgttttgaaaaatggttacttatcactgtcagacattaaccttttggtgtttgatgagtgtcatcttgcaatcctagaccacccctatcgagaatttatgaagctctgtgaaatttgtccatcatgtcctcgcattttgggactaactgcttccattttaaatgggaaatgggatccagaggatttggaagaaaagtttcagaaactagagaaaattcttaagagtaatgctgaaactgcaactgacctggtggtcttagacaggtatacttctcagccatgtgagattgtggtggattgtggaccatttactgacagaagtgggctttatgaaagactgctgatggaattagaagaagcacttaattttatcaatgattgtaatatatctgtacattcaaaagaaagagattctactttaatttcgaaacagatactatcagactgtcgtgccgtattggtagttctgggaccctggtgtgcagataaagtagctggaatgatggtaagagaactacagaaatacatcaaacatgagcaagaggagctgcacaggaaatttttattgtttacagacactttcctaaggaaaatacatgcactatgtgaagagcacttctcacctgcctcacttgacctgaaatttgtaactcctaaagtaatcaaactgctcgaaatcttacgcaaatataaaccatatgagcgacacagttttgaaagcgttgagtggtataataatagaaatcaggataattatgtgtcatggagtgattctgaggatgatgatgaggatgaagaaattgaagaaaaagagaagccagagacaaattttccttctccttttaccaacattttgtgcggaattatttttgtggaaagaagatacacagcagttgtcttaaacagattgataaaggaagctggcaaacaagatccagagctggcttatatcagtagcaatttcataactggacatggcattgggaagaatcagcctcgcaacaaacacgatggaagcagaattcagaaaacaggaagaggtacttaggaaatttcgagcacatgagaccaacctgcttattgcaacaagtattgtagaagagggtgttgatataccaaaatgcaacttggtggttcgttttgatttgcccacagaatatcgatcctatgttcaatctaaaggaagagcaagggcacccatctctaattatataatgttagcggatacagacaaaataaaaagttttgaagaagaccttaaaacctacaaagctattgaaaagatcttgagaaacaagtgttccaagtcggttgatactggtgagactgacattgatcctgtcatggatgatgatgacgttttcccaccatatgtgttgaggcctgacgatggtggtccacgagtcacaatcaacacggccattggacacatcaatagatactgtgctagattaccaagtgatccgtttactcatctagctcctaaatgcagaacccgagagttgcctgatggtacattttattcaactctttatctgccaattaactcacctcttcgagcctccattgttggtccaccaatgagctgtgtacgattggctgaaagagttgtagctctcatttgctgtgagaaactgcacaaaattggcgaactggatgaccatttgatgccagttgggaaagagactgttaaatatgaagaggagcttgatttgcatgatgaagaagagaccagtgttccaggaagaccaggttccacgaaacgaaggcagtgctacccaaaagcaattccagagtgtttgagggatagttatcccagacctgatcagccctgttacctgtatgtgataggaatggttttaactacacctttacctgatgaactcaactttagaaggcggaagctctatcctcctgaagataccacaagatgctttggaatactgacggccaaacccatacctcagattccacactttcctgtgtacacacgctctggagaggttaccatatccattgagttgaagaagtctggtttcatgttgtctctacaaatgcttgagttgattacaagacttcaccagtatatattctcacatattcttcggcttgaaaaacctgcactagaatttaaacctacagacgctgattcagcatactgtgttctacctcttaatgttgttaatgactccagcactttggatattgactttaaattcatggaagatattgagaagtctgaagctcgcataggcattcccagtacaaagtatacaaaagaaacaccctttgtttttaaattagaagattaccaagatgccgttatcattccaagatatcgcaattttgatcagcctcatcgattttatgtagctgatgtgtacactgatcttaccccactcagtaaatttccttcccctgagtatgaaacttttgcagaatattataaaacaaagtacaaccttgacctaaccaatctcaaccagccactgctggatgtggaccacacatcttcaagacttaatcttttgacacctcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttagataccctaacttagacttcgggtggaaaaaatctattgacagcaaatctttcatctcaatttctaactcctcttcagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagaatttatacagttacgagaaccagccccagcccagcgatgaatgtactctcctgagtaataaataccttgatggaaatgctaacaaatctacctcagatggaagtcctgtgatggccgtaatgcctggtacgacagacactattcaagtgctcaagggcaggatggattctgagcagagcccttctattgggtactcctcaaggactcttggccccaatcctggacttattcttcaggctttgactctgtcaaacgctagtgatggatttaacctggagcggcttgaaatgcttggcgactcctttttaaagcatgccatcaccacatatctattttgcacttaccctgatgcgcatgagggccgcctttcatatatgagaagcaaaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatgacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactgattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaatagaaaagttttctgcaaatgtaccccgttcccctgtgcgagaattgcttgaaatggaaccagaaactgccaaatttaggtaagcaaaaaatgtacatggaaaaaacattaacttaaaaacatcaaaggggaaaagttcacaaagatattgtaaactaatgattctgaaaaatatttacactgtggtgtgctgttgtcagatttctgtttgtaatctgattgacttctcttttttccttctgtttttatgaaataatgctgtaataaagactagacggcagccctgtctgtcgggggtatgcaattgcagtaagtcgtaacgcgtgtttcctttgtgtggtgtcagcttatacatgggactcctggcctgagagtgcacactaaatgctgattgacaatgataataaatacttctgacttctaattcaagctgtttggattttttacagcccggctgagagaacttacgacgggaaggtcagagtcactgtggaagtagtaggaaaggggaaatttaaaggtgttggtcgaagttacaggattgccaaatctgcagcagcaagaagagccctccgaagcctcaaagctaatcaacctcaggttcccaatagctgaaaccgctttttaaaattcaaaacaagaaacaaaacaaaaaaaattaaggggaaaattatttaaatcggaaaggaagacttaaagttgatagtgagtggaatgaattgaaggcagaatttaaagtttggttgataacaggatagataacagaataaaacatttaacatatgtataaaattttggaactaattgtagttttagttttttgcgcaaacacaatcttatcttctttcctcacttctgctttgtttaaatcacaagagtgctttaatgatgacatttagcaagtgctcaaaataattgacaggttttgtttttttttttttgagtttatgtcagctttgcttagtgttagaaggccatggagcttaaacctccagcagtccctaggatgatgtagattcttctccatctctccgtgtgtgcagtagtgccagtcctgcagtagttgataagctgaatagaaagataaggttttcgagaggagaagtgcgccaatgttgtcttttctttccacgttatactgtgtaaggtgatgttcccggtcgctgttgcacctgatagtaagggacagatttttaatgaacattggctggcatgttggtgaatcacattttagttttctgatgccacatagtcttgcataaaaaagggttcttgccttaaaagtgaaaccttcatggatagtctttaatctctgatctttttggaacaaactgttttacattcctttcattttattatgcattagacgttgagacagcgtgatacttacaactcactagtatagttgtaacttattacaggatcatactaaaatttctgtcatatgtatactgaagacattttaaaaaccagaatatgtagtctacggatattttttatcataaaaatgatctttggctaaacaccccattttactaaagtcctcctgccaggtagttcccactgatggaaatgtttatggcaaataattttgccttctaggctgttgctctaacaaaataaaccttagacatatcacacctaaaatatgctgcagattttataattgattggttacttatttaagaagcaaaacacagcacctttacccttagtctcctcacataaatttcttactatacttttcataatgttgcatgcatatttcacctaccaaagctgtgctgttaatgccgtgaaagtttaacgtttgcgataaactgccgtaattttgatacatctgtgatttaggtcattaatttagataaactagctcattatttccatctttggaaaaggaaaaaaaaaaaaacttctttaggcatttgcctaagtttctttaattagacttgtaggcactcttcacttaaatacctcagttcttcttttcttttgcatgcatttttcccctgtttggtgctatgtttatgtattatgcttgaaattttaattttttttttttttgcactgtaactataatacctcttaatttacctttttaaaagctgtgggtcagtcttgcactcccatcaacataccagtagaggtttgctgcaatttgccccgttaattatgcttgaagtttaagaaagctgagcagaggtgtctcatatttcccagcacatgattctgaacttgatgcttcatggaatgctgcatttatatgtaagtgacatttgaatactgtccttcctgctttatctgcatcatccacccacagagaaatgcctctgtgcgagtgcaccgacagaaaactgtcagctctgctttctaaggaaccctgagtgaggggggtattaagcttctccagtgttttttgttgtctccaatcttaaacttaaattgagatctaaattattaaacgagtttttgagcaaattaggtgacttgttttaaaaatatttaattccgatttggaaccttagatgtctatttgattttttaaaaaaccttaatgtaagatatgaccagttaaaacaaagcaattcttgaattatataactgtaaaagtgtgcagttaacaaggctggatgtgaattttattctgagggtgatttgtgatcaagtttaatcacaaatctcttaatatttataaactacctgatgccaggagcttagggctttgcattgtgtctaatacattgatcccagtgttacgggattctcttgattcctggcaccaaaatcagattgttttcacagttatgattcccagtgggagaaaaatgcctcaatatatttgtaaccttaagaagagtatttttttgttaatactaagatgttcaaacttagacatgattaggtcatacattctcaggggttcaaatttccttctaccattcaaatgttttatcaacagcaaacttcagccgtttcactttttgttggagaaaaatagtagattttaatttgactcacagtttgaagcattctgtgatcccctggttactgagttaaaaaataaaaaagtacgagttagacatatgaaatggttatgaacgcttttgtgctgctgatttttaatgctgtaaagttttcctgtgtttagcttgttgaaatgttttgcatctgtcaattaaggaaaaaaaaaatcactctatgttgccccactttagagccctgtgtgccaccctgtgttcctgtgattgcaatgtgagaccgaatgtaatatggaaaacctaccagtggggtgtggttgtgccctgagcacgtgtgtaaaggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaagaaaatatgcttaacagagaggaaaaaaatgtggtttggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcttttttcttttatattacgtgaagtgatgaaatttagaatgacctctaacactcctgtaattgtcttttaaaatactgatatttttatttgttaataatactttgccctcagaaagattctgataccctgccttgacaacatgaaacttgaggctgctttggttcatgaatccaggtgttcccccggcagtcggcttcttcagtcgctccctggaggcaggtgggcactgcagaggatcactggaatccagatcgagcgcagttcatgcacaaggccccgttgatttaaaatattggatcttgctctgttagggtgtctaatccctttacacaagattgaagccaccaaactgagaccttgatacctttttttaactgcatctgaaattatgttaagagtctttaacccatttgcattatctgcagaagagaaactcatgtcatgtttattacctatatggttgttttaattacatttgaataattatatttttccaaccactgattacttttcaggaatttaattatttccagataaatttctttattttatattgtacatgaaaagttttaaagatatgtttaagaccaagactattaaaatgatttttaaagttgttggagacgccaatagcaatatctaggaaatttgcattgagaccattgtattttccactagcagtgaaaatgatttttcacaactaacttgtaaatatattttaatcattacttctttttttctagtccatttttatttggacatcaaccacagacaatttaaattttatagatgcactaagaattcactgcagcagcaggttacatagcaaaaatgcaaaggtgaacaggaagtaaatttctggcttttctgctgtaaatagtgaaggaaaattactaaaatcaagtaaaactaatgcatattatttgattgacaataaaatatttaccatcacatgctgcagctgttttttaaggaacatgatgtcattcattcatacagtaatcatgctgcagaaatttgcagtctgcaccttatggatcacaattacctttagttgttttttttgtaataattgtagccaagtaaatctccaataaagttatcgtctgttca

SEQ ID NO: 437112 - DNA, 9111 bp, Homo sapiens
ggaaactctgaaagaacttagaatcagcattttgagagcagaagcttgggcatgctgtgattttccaataaactgctatcacaatgtcaaaatgcagttcagacaagagcaacacagagatctcaaacattaaaacgtaagctgtgctagaacaaaaatgcaatgaaagaaacactggatgaatgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaagacatttattgctagtactactctactaaagagctgtctctatctagatctaggggagacttcagctagaaatggaaaaaggacggtgttcttggtcaactctgcaaaccaggttgctcaacaagtgtcagctgtcagaactcattcagatctcaaggttggggaatactcaaacctagaagtaaatgcatcttggacaaaagagagatggaaccaagagtttactaagcaccaggttctcattatgacttgctatgtcgccttgaatgttttgaaaaatggttacttatcactgtcagacattaaccttttggtgtttgatgagtgtcatcttgcaatcctagaccacccctatcgagaatttatgaagctctgtgaaatttgtccatcatgtcctcgcattttgggactaactgcttccattttaaatgggaaatgggatccagaggatttggaagaaaagtttcagaaactagagaaaattcttaagagtaatgctgaaactgcaactgacctggtggtcttagacaggtatacttctcagccatgtgagattgtggtggattgtggaccatttactgacagaagtgggctttatgaaagactgctgatggaattagaagaagcacttaattttatcaatgattgtaatatatctgtacattcaaaagaaagagattctactttaatttcgaaacagatactatcagactgtcgtgccgtattggtagttctgggaccctggtgtgcagataaagtagctggaatgatggtaagagaactacagaaatacatcaaacatgagcaagaggagctgcacaggaaatttttattgtttacagacactttcctaaggaaaatacatgcactatgtgaagagcacttctcacctgcctcacttgacctgaaatttgtaactcctaaagtaatcaaactgctcgaaatcttacgcaaatataaaccatatgagcgacacagttttgaaagcgttgagtggtataataatagaaatcaggataattatgtgtcatggagtgattctgaggatgatgatgaggatgaagaaattgaagaaaaagagaagccagagacaaattttccttctccttttaccaacattttgtgcggaattatttttgtggaaagaagatacacagcagttgtcttaaacagattgataaaggaagctggcaaacaagatccagagctggcttatatcagtagcaatttcataactggacatggcattgggaagaatcagcctcgcaacaaacacgatggaagcagaattcagaaaacaggaagaggtacttaggaaatttcgagcacatgagaccaacctgcttattgcaacaagtattgtagaagagggtgttgatataccaaaatgcaacttggtggttcgttttgatttgcccacagaatatcgatcctatgttcaatctaaaggaagagcaagggcacccatctctaattatataatgttagcggatacagacaaaataaaaagttttgaagaagaccttaaaacctacaaagctattgaaaagatcttgagaaacaagtgttccaagtcggttgatactggtgagactgacattgatcctgtcatggatgatgatgacgttttcccaccatatgtgttgaggcctgacgatggtggtccacgagtcacaatcaacacggccattggacacatcaatagatactgtgctagattaccaagtgatccgtttactcatctagctcctaaatgcagaacccgagagttgcctgatggtacattttattcaactctttatctgccaattaactcacctcttcgagcctccattgttggtccaccaatgagctgtgtacgattggctgaaagagttgtagctctcatttgctgtgagaaactgcacaaaattggcgaactggatgaccatttgatgccagttgggaaagagactgttaaatatgaagaggagcttgatttgcatgatgaagaagagaccagtgttccaggaagaccaggttccacgaaacgaaggcagtgctacccaaaagcaattccagagtgtttgagggatagttatcccagacctgatcagccctgttacctgtatgtgataggaatggttttaactacacctttacctgatgaactcaactttagaaggcggaagctctatcctcctgaagataccacaagatgctttggaatactgacggccaaacccatacctcagattccacactttcctgtgtacacacgctctggagaggttaccatatccattgagttgaagaagtctggtttcatgttgtctctacaaatgcttgagttgattacaagacttcaccagtatatattctcacatattcttcggcttgaaaaacctgcactagaatttaaacctacagacgctgattcagcatactgtgttctacctcttaatgttgttaatgactccagcactttggatattgactttaaattcatggaagatattgagaagtctgaagctcgcataggcattcccagtacaaagtatacaaaagaaacaccctttgtttttaaattagaagattaccaagatgccgttatcattccaagatatcgcaattttgatcagcctcatcgattttatgtagctgatgtgtacactgatcttaccccactcagtaaatttccttcccctgagtatgaaacttttgcagaatattataaaacaaagtacaaccttgacctaaccaatctcaaccagccactgctggatgtggaccacacatcttcaagacttaatcttttgacacctcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttagataccctaacttagacttcgggtggaaaaaatctattgacagcaaatctttcatctcaatttctaactcctcttcagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagaatttatacagttacgagaaccagccccagcccagcgatgaatgtactctcctgagtaataaataccttgatggaaatgctaacaaatctacctcagatggaagtcctgtgatggccgtaatgcctggtacgacagacactattcaagtgctcaagggcaggatggattctgagcagagcccttctattgggtactcctcaaggactcttggccccaatcctggacttattcttcaggctttgactctgtcaaacgctagtgatggatttaacctggagcggcttgaaatgcttggcgactcctttttaaagcatgccatcaccacatatctattttgcacttaccctgatgcgcatgagggccgcctttcatatatgagaagcaaaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatgacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactgattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaatagaaaagttttctgcaaatgtaccccgttcccctgtgcgagaattgcttgaaatggaaccagaaactgccaaatttagcccggctgagagaacttacgacgggaaggtcagagtcactgtggaagtagtaggaaaggggaaatttaaaggtgttggtcgaagttacagattttataattgattggttacttatttaagaagcaaaacacagcacctttacccttagtctcctcacataaatttcttactatacttttcataatgttgcatgcatatttcacctaccaaagctgtgctgttaatgccgtgaaagtttaacgtttgcgataaactgccgtaattttgatacatctgtgatttaggtcattaatttagataaactagctcattatttccatctttggaaaaggaaaaaaaaaaaaacttctttaggcatttgcctaagtttctttaattagacttgtaggcactcttcacttaaatacctcagttcttcttttcttttgcatgcatttttcccctgtttggtgctatgtttatgtattatgcttgaaattttaattttttttttttttgcactgtaactataatacctcttaatttacctttttaaaagctgtgggtcagtcttgcactcccatcaacataccagtagaggtttgctgcaatttgccccgttaattatgcttgaagtttaagaaagctgagcagaggtgtctcatatttcccagcacatgattctgaacttgatgcttcatggaatgctgcatttatatgtaagtgacatttgaatactgtccttcctgctttatctgcatcatccacccacagagaaatgcctctgtgcgagtgcaccgacagaaaactgtcagctctgctttctaaggaaccctgagtgaggggggtattaagcttctccagtgttttttgttgtctccaatcttaaacttaaattgagatctaaattattaaacgagtttttgagcaaattaggtgacttgttttaaaaatatttaattccgatttggaaccttagatgtctatttgattttttaaaaaaccttaatgtaagatatgaccagttaaaacaaagcaattcttgaattatataactgtaaaagtgtgcagttaacaaggctggatgtgaattttattctgagggtgatttgtgatcaagtttaatcacaaatctcttaatatttataaactacctgatgccaggagcttagggctttgcattgtgtctaatacattgatcccagtgttacgggattctcttgattcctggcaccaaaatcagattgttttcacagttatgattcccagtgggagaaaaatgcctcaatatatttgtaaccttaagaagagtatttttttgttaatactaagatgttcaaacttagacatgattaggtcatacattctcaggggttcaaatttccttctaccattcaaatgttttatcaacagcaaacttcagccgtttcactttttgttggagaaaaatagtagattttaatttgactcacagtttgaagcattctgtgatcccctggttactgagttaaaaaataaaaaagtacgagttagacatatgaaatggttatgaacgcttttgtgctgctgatttttaatgctgtaaagttttcctgtgtttagcttgttgaaatgttttgcatctgtcaattaaggaaaaaaaaaatcactctatgttgccccactttagagccctgtgtgccaccctgtgttcctgtgattgcaatgtgagaccgaatgtaatatggaaaacctaccagtggggtgtggttgtgccctgagcacgtgtgtaaaggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaagaaaatatgcttaacagagaggaaaaaaatgtggtttggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcttttttcttttatattacgtgaagtgatgaaatttagaatgacctctaacactcctgtaattgtcttttaaaatactgatatttttatttgttaataatactttgccctcagaaagattctgataccctgccttgacaacatgaaacttgaggctgctttggttcatgaatccaggtgttcccccggcagtcggcttcttcagtcgctccctggaggcaggtgggcactgcagaggatcactggaatccagatcgagcgcagttcatgcacaaggccccgttgatttaaaatattggatcttgctctgttagggtgtctaatccctttacacaagattgaagccaccaaactgagaccttgatacctttttttaactgcatctgaaattatgttaagagtctttaacccatttgcattatctgcagaagagaaactcatgtcatgtttattacctatatggttgttttaattacatttgaataattatatttttccaaccactgattacttttcaggaatttaattatttccagataaatttctttattttatattgtacatgaaaagttttaaagatatgtttaagaccaagactattaaaatgatttttaaagttgttggagacgccaatagcaatatctaggaaatttgcattgagaccattgtattttccactagcagtgaaaatgatttttcacaactaacttgtaaatatattttaatcattacttctttttttctagtccatttttatttggacatcaaccacagacaatttaaattttatagatgcactaagaattcactgcagcagcaggttacatagcaaaaatgcaaaggtgaacaggaagtaaatttctggcttttctgctgtaaatagtgaaggaaaattactaaaatcaagtaaaactaatgcatattatttgattgacaataaaatatttaccatcacatgctgcagctgttttttaaggaacatgatgtcattcattcatacagtaatcatgctgcagaaatttgcagtctgcaccttatggatcacaattacctttagttgttttttttgtaataattgtagccaagtaaatctccaataaagttatcgtctgttca

SEQ ID NO: 437113 - DNA, 4040 bp, Homo sapiens
ttaaatgctttacactctggcgtggaccctaaagaaataaggttccaaagagccaatctctcttgataaccctgattatggttacaaggataccaaaccttccaattccagatctggacaaagtgtatagccaatataagacaattatgagaactgccagtgattccaaatgcagtttcccactaagtcttttgtatgagatcatctcctgcagtagttgataagctgaatagaaagataaggttttcgagaggagaagtgcgccaatgttgtcttttctttccacgttatactgtgtaaggtgatgttcccggtcgctgttgcacctgatagtaagggacagatttttaatgaacattggctggcatgttggtgaatcacattttagttttctgatgccacatagtcttgcataaaaaagggttcttgccttaaaagtgaaaccttcatggatagtctttaatctctgatctttttggaacaaactgttttacattcctttcattttattatgcattagacgttgagacagcgtgatacttacaactcactagtatagttgtaacttattacaggatcatactaaaatttctgtcatatgtatactgaagacattttaaaaaccagaatatgtagtctacggatattttttatcataaaaatgatctttggctaaacaccccattttactaaagtcctcctgccaggtagttcccactgatggaaatgtttatggcaaataattttgccttctaggctgttgctctaacaaaataaaccttagacatatcacacctaaaatatgctgcagattttataattgattggttacttatttaagaagcaaaacacagcacctttacccttagtctcctcacataaatttcttactatacttttcataatgttgcatgcatatttcacctaccaaagctgtgctgttaatgccgtgaaagtttaacgtttgcgataaactgccgtaattttgatacatctgtgatttaggtcattaatttagataaactagctcattatttccatctttggaaaaggaaaaaaaaaaaaacttctttaggcatttgcctaagtttctttaattagacttgtaggcactcttcacttaaatacctcagttcttcttttcttttgcatgcatttttcccctgtttggtgctatgtttatgtattatgcttgaaattttaattttttttttttttgcactgtaactataatacctcttaatttacctttttaaaagctgtgggtcagtcttgcactcccatcaacataccagtagaggtttgctgcaatttgccccgttaattatgcttgaagtttaagaaagctgagcagaggtgtctcatatttcccagcacatgattctgaacttgatgcttcatggaatgctgcatttatatgtaagtgacatttgaatactgtccttcctgctttatctgcatcatccacccacagagaaatgcctctgtgcgagtgcaccgacagaaaactgtcagctctgctttctaaggaaccctgagtgaggggggtattaagcttctccagtgttttttgttgtctccaatcttaaacttaaattgagatctaaattattaaacgagtttttgagcaaattaggtgacttgttttaaaaatatttaattccgatttggaaccttagatgtctatttgattttttaaaaaaccttaatgtaagatatgaccagttaaaacaaagcaattcttgaattatataactgtaaaagtgtgcagttaacaaggctggatgtgaattttattctgagggtgatttgtgatcaagtttaatcacaaatctcttaatatttataaactacctgatgccaggagcttagggctttgcattgtgtctaatacattgatcccagtgttacgggattctcttgattcctggcaccaaaatcagattgttttcacagttatgattcccagtgggagaaaaatgcctcaatatatttgtaaccttaagaagagtatttttttgttaatactaagatgttcaaacttagacatgattaggtcatacattctcaggggttcaaatttccttctaccattcaaatgttttatcaacagcaaacttcagccgtttcactttttgttggagaaaaatagtagattttaatttgactcacagtttgaagcattctgtgatcccctggttactgagttaaaaaataaaaaagtacgagttagacatatgaaatggttatgaacgcttttgtgctgctgatttttaatgctgtaaagttttcctgtgtttagcttgttgaaatgttttgcatctgtcaattaaggaaaaaaaaaatcactctatgttgccccactttagagccctgtgtgccaccctgtgttcctgtgattgcaatgtgagaccgaatgtaatatggaaaacctaccagtggggtgtggttgtgccctgagcacgtgtgtaaaggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaagaaaatatgcttaacagagaggaaaaaaatgtggtttggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcttttttcttttatattacgtgaagtgatgaaatttagaatgacctctaacactcctgtaattgtcttttaaaatactgatatttttatttgttaataatactttgccctcagaaagattctgataccctgccttgacaacatgaaacttgaggctgctttggttcatgaatccaggtgttcccccggcagtcggcttcttcagtcgctccctggaggcaggtgggcactgcagaggatcactggaatccagatcgagcgcagttcatgcacaaggccccgttgatttaaaatattggatcttgctctgttagggtgtctaatccctttacacaagattgaagccaccaaactgagaccttgatacctttttttaactgcatctgaaattatgttaagagtctttaacccatttgcattatctgcagaagagaaactcatgtcatgtttattacctatatggttgttttaattacatttgaataattatatttttccaaccactgattacttttcaggaatttaattatttccagataaatttctttattttatattgtacatgaaaagttttaaagatatgtttaagaccaagactattaaaatgatttttaaagttgttggagacgccaatagcaatatctaggaaatttgcattgagaccattgtattttccactagcagtgaaaatgatttttcacaactaacttgtaaatatattttaatcattacttctttttttctagtccatttttatttggacatcaaccacagacaatttaaattttatagatgcactaagaattcactgcagcagcaggttacatagcaaaaatgcaaaggtgaacaggaagtaaatttctggcttttctgctgtaaatagtgaaggaaaattactaaaatcaagtaaaactaatgcatattatttgattgacaataaaatatttaccatcacatgctgcagctgttttttaaggaacatgatgtcattcattcatacagtaatcatgctgcagaaatttgcagtctgcaccttatggatcacaattacctttagttgttttttttgtaataattgtagccaagtaaatctccaataaagttatcgtctgttca

SEQ ID NO: 437114 - DNA, 3505 bp, Homo sapiens
taatgagctagtttatctaaattaatgacctaaattacaggatcatactaaaatttctgtcatatgtatactgaagacattttaaaaaccagaatatgtagtctacggatattttttatcataaaaatgatctttggctaaacaccccattttactaaagtcctcctgccaggtagttcccactgatggaaatgtttatggcaaataattttgccttctaggctgttgctctaacaaaataaaccttagacatatcacacctaaaatatgctgcagattttataattgattggttacttatttaagaagcaaaacacagcacctttacccttagtctcctcacataaatttcttactatacttttcataatgttgcatgcatatttcacctaccaaagctgtgctgttaatgccgtgaaagtttaacgtttgcgataaactgccgtaattttgatacatctgtgatttaggtcattaatttagataaactagctcattatttccatctttggaaaaggaaaaaaaaaaaaacttctttaggcatttgcctaagtttctttaattagacttgtaggcactcttcacttaaatacctcagttcttcttttcttttgcatgcatttttcccctgtttggtgctatgtttatgtattatgcttgaaattttaattttttttttttttgcactgtaactataatacctcttaatttacctttttaaaagctgtgggtcagtcttgcactcccatcaacataccagtagaggtttgctgcaatttgccccgttaattatgcttgaagtttaagaaagctgagcagaggtgtctcatatttcccagcacatgattctgaacttgatgcttcatggaatgctgcatttatatgtaagtgacatttgaatactgtccttcctgctttatctgcatcatccacccacagagaaatgcctctgtgcgagtgcaccgacagaaaactgtcagctctgctttctaaggaaccctgagtgaggggggtattaagcttctccagtgttttttgttgtctccaatcttaaacttaaattgagatctaaattattaaacgagtttttgagcaaattaggtgacttgttttaaaaatatttaattccgatttggaaccttagatgtctatttgattttttaaaaaaccttaatgtaagatatgaccagttaaaacaaagcaattcttgaattatataactgtaaaagtgtgcagttaacaaggctggatgtgaattttattctgagggtgatttgtgatcaagtttaatcacaaatctcttaatatttataaactacctgatgccaggagcttagggctttgcattgtgtctaatacattgatcccagtgttacgggattctcttgattcctggcaccaaaatcagattgttttcacagttatgattcccagtgggagaaaaatgcctcaatatatttgtaaccttaagaagagtatttttttgttaatactaagatgttcaaacttagacatgattaggtcatacattctcaggggttcaaatttccttctaccattcaaatgttttatcaacagcaaacttcagccgtttcactttttgttggagaaaaatagtagattttaatttgactcacagtttgaagcattctgtgatcccctggttactgagttaaaaaataaaaaagtacgagttagacatatgaaatggttatgaacgcttttgtgctgctgatttttaatgctgtaaagttttcctgtgtttagcttgttgaaatgttttgcatctgtcaattaaggaaaaaaaaaatcactctatgttgccccactttagagccctgtgtgccaccctgtgttcctgtgattgcaatgtgagaccgaatgtaatatggaaaacctaccagtggggtgtggttgtgccctgagcacgtgtgtaaaggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaagaaaatatgcttaacagagaggaaaaaaatgtggtttggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcttttttcttttatattacgtgaagtgatgaaatttagaatgacctctaacactcctgtaattgtcttttaaaatactgatatttttatttgttaataatactttgccctcagaaagattctgataccctgccttgacaacatgaaacttgaggctgctttggttcatgaatccaggtgttcccccggcagtcggcttcttcagtcgctccctggaggcaggtgggcactgcagaggatcactggaatccagatcgagcgcagttcatgcacaaggccccgttgatttaaaatattggatcttgctctgttagggtgtctaatccctttacacaagattgaagccaccaaactgagaccttgatacctttttttaactgcatctgaaattatgttaagagtctttaacccatttgcattatctgcagaagagaaactcatgtcatgtttattacctatatggttgttttaattacatttgaataattatatttttccaaccactgattacttttcaggaatttaattatttccagataaatttctttattttatattgtacatgaaaagttttaaagatatgtttaagaccaagactattaaaatgatttttaaagttgttggagacgccaatagcaatatctaggaaatttgcattgagaccattgtattttccactagcagtgaaaatgatttttcacaactaacttgtaaatatattttaatcattacttctttttttctagtccatttttatttggacatcaaccacagacaatttaaattttatagatgcactaagaattcactgcagcagcaggttacatagcaaaaatgcaaaggtgaacaggaagtaaatttctggcttttctgctgtaaatagtgaaggaaaattactaaaatcaagtaaaactaatgcatattatttgattgacaataaaatatttaccatcacatgctgcagctgttttttaaggaacatgatgtcattcattcatacagtaatcatgctgcagaaatttgcagtctgcaccttatggatcacaattacctttagttgttttttttgtaataattgtagccaagtaaatctccaataaagttatcgtctgttca

SEQ ID NO: 437115 - DNA, 1902 bp, Homo sapiens
gaaaaaggtggttctcttcccaaagtggaagccaaattcatcaattatgtgaagaattgcttccggatgactgaccaagaggctattcaagatctctggcagtggaggaagtctctttaagaaaatagtttaaacaattttttaacaaattttcctgtgtttagcttgttgaaatgttttgcatctgtcaattaaggaaaaaaaaaatcactctatgttgccccactttagagccctgtgtgccaccctgtgttcctgtgattgcaatgtgagaccgaatgtaatatggaaaacctaccagtggggtgtggttgtgccctgagcacgtgtgtaaaggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaagaaaatatgcttaacagagaggaaaaaaatgtggtttggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcttttttcttttatattacgtgaagtgatgaaatttagaatgacctctaacactcctgtaattgtcttttaaaatactgatatttttatttgttaataatactttgccctcagaaagattctgataccctgccttgacaacatgaaacttgaggctgctttggttcatgaatccaggtgttcccccggcagtcggcttcttcagtcgctccctggaggcaggtgggcactgcagaggatcactggaatccagatcgagcgcagttcatgcacaaggccccgttgatttaaaatattggatcttgctctgttagggtgtctaatccctttacacaagattgaagccaccaaactgagaccttgatacctttttttaactgcatctgaaattatgttaagagtctttaacccatttgcattatctgcagaagagaaactcatgtcatgtttattacctatatggttgttttaattacatttgaataattatatttttccaaccactgattacttttcaggaatttaattatttccagataaatttctttattttatattgtacatgaaaagttttaaagatatgtttaagaccaagactattaaaatgatttttaaagttgttggagacgccaatagcaatatctaggaaatttgcattgagaccattgtattttccactagcagtgaaaatgatttttcacaactaacttgtaaatatattttaatcattacttctttttttctagtccatttttatttggacatcaaccacagacaatttaaattttatagatgcactaagaattcactgcagcagcaggttacatagcaaaaatgcaaaggtgaacaggaagtaaatttctggcttttctgctgtaaatagtgaaggaaaattactaaaatcaagtaaaactaatgcatattatttgattgacaataaaatatttaccatcacatgctgcagctgttttttaaggaacatgatgtcattcattcatacagtaatcatgctgcagaaatttgcagtctgcaccttatggatcacaattacctttagttgttttttttgtaataattgtagccaagtaaatctccaataaagttatcgtctgttca

SEQ ID NO: 437116 - DNA, 5768 bp, Homo sapiens
ggaaactctgaaagaacttagaatcagcattttgagagcagaagcttgggcatgctgtgattttccaataaactgctatcacaatgtcaaaatgcagttcagacaagagcaacacagagatctcaaacattaaaacgtaagctgtgctagaacaaaaatgcaatgaaagaaacactggatgaatgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaagacatttattgctagtactactctactaaagagctgtctctatctagatctaggggagacttcagctagaaatggaaaaaggacggtgttcttggtcaactctgcaaaccaggttgctcaacaagtgtcagctgtcagaactcattcagatctcaaggttggggaatactcaaacctagaagtaaatgcatcttggacaaaagagagatggaaccaagagtttactaagcaccaggttctcattatgacttgctatgtcgccttgaatgttttgaaaaatggttacttatcactgtcagacattaaccttttggtgtttgatgagtgtcatcttgcaatcctagaccacccctatcgagaatttatgaagctctgtgaaatttgtccatcatgtcctcgcattttgggactaactgcttccattttaaatgggaaatgggatccagaggatttggaagaaaagtttcagaaactagagaaaattcttaagagtaatgctgaaactgcaactgacctggtggtcttagacaggtatacttctcagccatgtgagattgtggtggattgtggaccatttactgacagaagtgggctttatgaaagactgctgatggaattagaagaagcacttaattttatcaatgattgtaatatatctgtacattcaaaagaaagagattctactttaatttcgaaacagatactatcagactgtcgtgccgtattggtagttctgggaccctggtgtgcagataaagtagctggaatgatggtaagagaactacagaaatacatcaaacatgagcaagaggagctgcacaggaaatttttattgtttacagacactttcctaaggaaaatacatgcactatgtgaagagcacttctcacctgcctcacttgacctgaaatttgtaactcctaaagtaatcaaactgctcgaaatcttacgcaaatataaaccatatgagcgacacagttttgaaagcgttgagtggtataataatagaaatcaggataattatgtgtcatggagtgattctgaggatgatgatgaggatgaagaaattgaagaaaaagagaagccagagacaaattttccttctccttttaccaacattttgtgcggaattatttttgtggaaagaagatacacagcagttgtcttaaacagattgataaaggaagctggcaaacaagatccagagctggcttatatcagtagcaatttcataactggacatggcattgggaagaatcagcctcgcaacaaacacgatggaagcagaattcagaaaacaggaagaggtacttaggaaatttcgagcacatgagaccaacctgcttattgcaacaagtattgtagaagagggtgttgatataccaaaatgcaacttggtggttcgttttgatttgcccacagaatatcgatcctatgttcaatctaaaggaagagcaagggcacccatctctaattatataatgttagcggatacagacaaaataaaaagttttgaagaagaccttaaaacctacaaagctattgaaaagatcttgagaaacaagtgttccaagtcggttgatactggtgagactgacattgatcctgtcatggatgatgatgacgttttcccaccatatgtgttgaggcctgacgatggtggtccacgagtcacaatcaacacggccattggacacatcaatagatactgtgctagattaccaagtgatccgtttactcatctagctcctaaatgcagaacccgagagttgcctgatggtacattttattcaactctttatctgccaattaactcacctcttcgagcctccattgttggtccaccaatgagctgtgtacgattggctgaaagagttgtagctctcatttgctgtgagaaactgcacaaaattggcgaactggatgaccatttgatgccagttgggaaagagactgttaaatatgaagaggagcttgatttgcatgatgaagaagagaccagtgttccaggaagaccaggttccacgaaacgaaggcagtgctacccaaaagcaattccagagtgtttgagggatagttatcccagacctgatcagccctgttacctgtatgtgataggaatggttttaactacacctttacctgatgaactcaactttagaaggcggaagctctatcctcctgaagataccacaagatgctttggaatactgacggccaaacccatacctcagattccacactttcctgtgtacacacgctctggagaggttaccatatccattgagttgaagaagtctggtttcatgttgtctctacaaatgcttgagttgattacaagacttcaccagtatatattctcacatattcttcggcttgaaaaacctgcactagaatttaaacctacagacgctgattcagcatactgtgttctacctcttaatgttgttaatgactccagcactttggatattgactttaaattcatggaagatattgagaagtctgaagctcgcataggcattcccagtacaaagtatacaaaagaaacaccctttgtttttaaattagaagattaccaagatgccgttatcattccaagatatcgcaattttgatcagcctcatcgattttatgtagctgatgtgtacactgatcttaccccactcagtaaatttccttcccctgagtatgaaacttttgcagaatattataaaacaaagtacaaccttgacctaaccaatctcaaccagccactgctggatgtggaccacacatcttcaagacttaatcttttgacacctcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttagataccctaacttagacttcgggtggaaaaaatctattgacagcaaatctttcatctcaatttctaactcctcttcagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagaatttatacagttacgagaaccagccccagcccagcgatgaatgtactctcctgagtaataaataccttgatggaaatgctaacaaatctacctcagatggaagtcctgtgatggccgtaatgcctggtacgacagacactattcaagtgctcaagggcaggatggattctgagcagagcccttctattgggtactcctcaaggactcttggccccaatcctggacttattcttcaggctttgactctgtcaaacgctagtgatggatttaacctggagcggcttgaaatgcttggcgactcctttttaaagcatgccatcaccacatatctattttgcacttaccctgatgcgcatgagggccgcctttcatatatgagaagcaaaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatgacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactggtaaggagcccacgaccagacttcatttctgggaaaatgagactttgtgttgatctcatcgtgttggccttgtaaaagtgatctatgcatgtacagtgttcatgcttaatattcaagggatggggcggggaacaaaaggaatagaaagaattcttttccttgttatttggggagcacgtattgctttataactttggttgttgggagtatggctatcatataccctcatcagtgtcattttatatctgcctaattagagaaattttaaccttagtattttgatgtgttttccccattttatcctccgcaaatatctttctcttgcccattcagtgctgcttttggtttttgatttagttgtatattctggatgtatttccacagccttttattgttcttcctggacaaaaagacccctcctttagggtctttttaaagatggatagattaaaagattaaaagcaatgatttcacaagaaaaaaa

SEQ ID NO: 437117 - DNA, 1622 bp, Homo sapiens
ggaaactctgaaagaacttagaatcagcattttgagagcagaagcttgggcatgctgtgattttccaataaactgctatcacaatgtcaaaatgcagttcagacaagagcaacacagagatctcaaacattaaaacgtaagctgtgctagaacaaaaatgcaatgaaagaaacactggatgaatgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaagacatttattgctagtactactctactaaagagctgtctctatctagatctaggggagacttcagctagaaatggaaaaaggacggtgttcttggtcaactctgcaaaccaggttgctcaacaagtgtcagctgtcagaactcattcagatctcaaggttggggaatactcaaacctagaagtaaatgcatcttggacaaaagagagatggaaccaagagtttactaagcaccaggttctcattatgacttgctatgtcgccttgaatgttttgaaaaatggttacttatcactgtcagacattaaccttttggtgtttgatgagtgtcatcttgcaatcctagaccacccctatcgagaatttatgaagctctgtgaaatttgtccatcatgtcctcgcattttgggactaactgcttccattttaaatgggaaatgggatccagaggatttggaagaaaagtttcagaaactagagaaaattcttaagagtaatgctgaaactgcaactgacctggtggtcttagacaggtatacttctcagccatgtgagattgtggtggattgtggaccatttactgacagaagtgggctttatgaaagactgctgatggaattagaagaagcacttaattttatcaatgattgtaatatatctgtacattcaaaagaaagagattctactttaatttcgaaacagatactatcagactgtcgtgccgtattggtagttctgggaccctggtgtgcagataaagtagctggaatgatggtaagagaactacagaaatacatcaaacatgagcaagaggagctgcacaggaaatttttattgtttacagacactttcctaaggaaaatacatgcactatgtgaagagcacttctcacctgcctcacttgacctgaaatttgtaactcctaaagtaatcaaactgctcgaaatcttacgcaaatataaaccatatgagcgacacagttttgaaagcgttgagtggtataataatagaaatcaggataattatgtgtcatggagtgattctgaggatgatgatgaggatgaagaaattgaagaaaaagagaagccagagacaaattttccttctccttttaccaacattttgtgcggaattatttttgtggaaagaagatacacagcagttgtcttaaacagattgataaaggtagctggcaaacaagatcctggaagacagataacagttacgatcact

SEQ ID NO: 437118 - DNA, 586 bp, Homo sapiens
tagtactattgaatgcttgccaagcagctagggagtagaactgttttaaagtatagttctttgattacgagtgaatttgaatttttttcatacttttattgactatttctaattctttgttaaggttgtttaaagttagaagtaatcttttttctttgctgggtatatagaataataaatggggtggggatattttttctttttttcttgagaagtttgaaaaacttttttaaaaatataacatttgttttactattacaatatagtaggcataccataaatggtatttccccccttactaaagaagtaacaaaagtcatatatccaagaaaagaaactacatctgtggactgcctgtaaaagtggcctttttgcttacaagtcacttttccctctgtaatagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaataggtattgttggctccctttag

SEQ ID NO: 437119 - DNA, 349 bp, Homo sapiens
tattctcatcagcttttagtaaagccagaattaatttgttttcttgctgacatctggaaaagaggctaatatgcttgagcatgacgcttaattttcctttccaactctagattccagagtgtttgagggatagttatcccagacctgatcagccctgttacctgtatgtgataggaatggttttaactacacctttacctgatgaactcaactttagaaggcggaagctctatcctcctgaagataccacaagatgctttggaatactgacggccaaacccatacctcaggtaggtatttcataatgagtacttatgtcaaaaacgtcttgcttaggaaaaggaaaaaa

SEQ ID NO: 437120 - DNA, 494 bp, Homo sapiens
aacttccaaatgtgtataattttcttagattgataaaggaagctggcaaacaagatccagagctggcttatatcagtagcaatttcataactggacatggcattgggaagaatcagcctcgcaacaaacacgatggaagcagaattcagaaaacaggaagaggtaacttaaatcaaaataagtgtacaataacagttttcgggacatatacagacaaagtgcccatagggtctcccttttttcatagtttcccagaattactattattttttgtattatagaatacttcttcatatattagaccagctgtccccatgaggtagctgtagagtgatttgtatgctcagaattagaatagctatctggcaaaccaattttgtgtcttaattgccatcaaccaacttattttctgtgattggattgatgttacacaactgcatttcatggaaagacaaagcatgtatgaccttaactcttgtacattccatatgact

SEQ ID NO: 437121 - DNA, 10409 bp, Homo sapiens
ggaaactctgaaagaacttagaatcagcattttgagagcagaagcttgggcatgctgtgattttccaataaactgctatcacaatgtcaaaatgcagttcagacaagagcaacacagagatctcaaacattaaaacgtaagctgtgctagaacaaaaatgcaatgaaagaaacactggatgaatgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaagacatttattgctagtactactctactaaagagctgtctctatctagatctaggggagacttcagctagaaatggaaaaaggacggtgttcttggtcaactctgcaaaccaggttgctcaacaagtgtcagctgtcagaactcattcagatctcaaggttggggaatactcaaacctagaagtaaatgcatcttggacaaaagagagatggaaccaagagtttactaagcaccaggttctcattatgacttgctatgtcgccttgaatgttttgaaaaatggttacttatcactgtcagacattaaccttttggtgtttgatgagtgtcatcttgcaatcctagaccacccctatcgagaatttatgaagctctgtgaaatttgtccatcatgtcctcgcattttgggactaactgcttccattttaaatgggaaatgggatccagaggatttggaagaaaagtttcagaaactagagaaaattcttaagagtaatgctgaaactgcaactgacctggtggtcttagacaggtatacttctcagccatgtgagattgtggtggattgtggaccatttactgacagaagtgggctttatgaaagactgctgatggaattagaagaagcacttaattttatcaatgattgtaatatatctgtacattcaaaagaaagagattctactttaatttcgaaacagatactatcagactgtcgtgccgtattggtagttctgggaccctggtgtgcagataaagtagctggaatgatggtaagagaactacagaaatacatcaaacatgagcaagaggagctgcacaggaaatttttattgtttacagacactttcctaaggaaaatacatgcactatgtgaagagcacttctcacctgcctcacttgacctgaaatttgtaactcctaaagtaatcaaactgctcgaaatcttacgcaaatataaaccatatgagcgacacagttttgaaagcgttgagtggtataataatagaaatcaggataattatgtgtcatggagtgattctgaggatgatgatgaggatgaagaaattgaagaaaaagagaagccagagacaaattttccttctccttttaccaacattttgtgcggaattatttttgtggaaagaagatacacagcagttgtcttaaacagattgataaaggaagctggcaaacaagatccagagctggcttatatcagtagcaatttcataactggacatggcattgggaagaatcagcctcgcaacaaacacgatggaagcagaattcagaaaacaggaagaggtacttaggaaatttcgagcacatgagaccaacctgcttattgcaacaagtattgtagaagagggtgttgatataccaaaatgcaacttggtggttcgttttgatttgcccacagaatatcgatcctatgttcaatctaaaggaagagcaagggcacccatctctaattatataatgttagcggatacagacaaaataaaaagttttgaagaagaccttaaaacctacaaagctattgaaaagatcttgagaaacaagtgttccaagtcggttgatactggtgagactgacattgatcctgtcatggatgatgatgacgttttcccaccatatgtgttgaggcctgacgatggtggtccacgagtcacaatcaacacggccattggacacatcaatagatactgtgctagattaccaagtgatccgtttactcatctagctcctaaatgcagaacccgagagttgcctgatggtacattttattcaactctttatctgccaattaactcacctcttcgagcctccattgttggtccaccaatgagctgtgtacgattggctgaaagagttgtagctctcatttgctgtgagaaactgcacaaaattggcgaactggatgaccatttgatgccagttgggaaagagactgttaaatatgaagaggagcttgatttgcatgatgaagaagagaccagtgttccaggaagaccaggttccacgaaacgaaggcagtgctacccaaaagcaattccagagtgtttgagggatagttatcccagacctgatcagccctgttacctgtatgtgataggaatggttttaactacacctttacctgatgaactcaactttagaaggcggaagctctatcctcctgaagataccacaagatgctttggaatactgacggccaaacccatacctcagattccacactttcctgtgtacacacgctctggagaggttaccatatccattgagttgaagaagtctggtttcatgttgtctctacaaatgcttgagttgattacaagacttcaccagtatatattctcacatattcttcggcttgaaaaacctgcactagaatttaaacctacagacgctgattcagcatactgtgttctacctcttaatgttgttaatgactccagcactttggatattgactttaaattcatggaagatattgagaagtctgaagctcgcataggcattcccagtacaaagtatacaaaagaaacaccctttgtttttaaattagaagattaccaagatgccgttatcattccaagatatcgcaattttgatcagcctcatcgattttatgtagctgatgtgtacactgatcttaccccactcagtaaatttccttcccctgagtatgaaacttttgcagaatattataaaacaaagtacaaccttgacctaaccaatctcaaccagccactgctggatgtggaccacacatcttcaagacttaatcttttgacacctcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttagataccctaacttagacttcgggtggaaaaaatctattgacagcaaatctttcatctcaatttctaactcctcttcagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagaatttatacagttacgagaaccagccccagcccagcgatgaatgtactctcctgagtaataaataccttgatggaaatgctaacaaatctacctcagatggaagtcctgtgatggccgtaatgcctggtacgacagacactattcaagtgctcaagggcaggatggattctgagcagagcccttctattgggtactcctcaaggactcttggccccaatcctggacttattcttcaggctttgactctgtcaaacgctagtgatggatttaacctggagcggcttgaaatgcttggcgactcctttttaaagcatgccatcaccacatatctattttgcacttaccctgatgcgcatgagggccgcctttcatatatgagaagcaaaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatgacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactgattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaatagaaaagttttctgcaaatgtaccccgttcccctgtgcgagaattgcttgaaatggaaccagaaactgccaaatttagcccggctgagagaacttacgacgggaaggtcagagtcactgtggaagtagtaggaaaggggaaatttaaaggtgttggtcgaagttacaggattgccaaatctgcagcagcaagaagagccctccgaagcctcaaagctaatcaacctcaggttcccaatagctgaaaccgctttttaaaattcaaaacaagaaacaaaacaaaaaaaattaaggggaaaattatttaaatcggaaaggaagacttaaagttgatagtgagtggaatgaattgaaggcagaatttaaagtttggttgataacaggatagataacagaataaaacatttaacatatgtataaaattttggaactaattgtagttttagttttttgcgcaaacacaatcttatcttctttcctcacttctgctttgtttaaatcacaagagtgctttaatgatgacatttagcaagtgctcaaaataattgacaggttttgtttttttttttttgagtttatgtcagctttgcttagtgttagaaggccatggagcttaaacctccagcagtccctaggatgatgtagattcttctccatctctccgtgtgtgcagtagtgccagtcctgcagtagttgataagctgaatagaaagataaggttttcgagaggagaagtgcgccaatgttgtcttttctttccacgttatactgtgtaaggtgatgttcccggtcgctgttgcacctgatagtaagggacagatttttaatgaacattggctggcatgttggtgaatcacattttagttttctgatgccacatagtcttgcataaaaaagggttcttgccttaaaagtgaaaccttcatggatagtctttaatctctgatctttttggaacaaactgttttacattcctttcattttattatgcattagacgttgagacagcgtgatacttacaactcactagtatagttgtaacttattacaggatcatactaaaatttctgtcatatgtatactgaagacattttaaaaaccagaatatgtagtctacggatattttttatcataaaaatgatctttggctaaacaccccattttactaaagtcctcctgccaggtagttcccactgatggaaatgtttatggcaaataattttgccttctaggctgttgctctaacaaaataaaccttagacatatcacacctaaaatatgctgcagattttataattgattggttacttatttaagaagcaaaacacagcacctttacccttagtctcctcacataaatttcttactatacttttcataatgttgcatgcatatttcacctaccaaagctgtgctgttaatgccgtgaaagtttaacgtttgcgataaactgccgtaattttgatacatctgtgatttaggtcattaatttagataaactagctcattatttccatctttggaaaaggaaaaaaaaaaaaacttctttaggcatttgcctaagtttctttaattagacttgtaggcactcttcacttaaatacctcagttcttcttttcttttgcatgcatttttcccctgtttggtgctatgtttatgtattatgcttgaaattttaattttttttttttttgcactgtaactataatacctcttaatttacctttttaaaagctgtgggtcagtcttgcactcccatcaacataccagtagaggtttgctgcaatttgccccgttaattatgcttgaagtttaagaaagctgagcagaggtgtctcatatttcccagcacatgattctgaacttgatgcttcatggaatgctgcatttatatgtaagtgacatttgaatactgtccttcctgctttatctgcatcatccacccacagagaaatgcctctgtgcgagtgcaccgacagaaaactgtcagctctgctttctaaggaaccctgagtgaggggggtattaagcttctccagtgttttttgttgtctccaatcttaaacttaaattgagatctaaattattaaacgagtttttgagcaaattaggtgacttgttttaaaaatatttaattccgatttggaaccttagatgtctatttgattttttaaaaaaccttaatgtaagatatgaccagttaaaacaaagcaattcttgaattatataactgtaaaagtgtgcagttaacaaggctggatgtgaattttattctgagggtgatttgtgatcaagtttaatcacaaatctcttaatatttataaactacctgatgccaggagcttagggctttgcattgtgtctaatacattgatcccagtgttacgggattctcttgattcctggcaccaaaatcagattgttttcacagttatgattcccagtgggagaaaaatgcctcaatatatttgtaaccttaagaagagtatttttttgttaatactaagatgttcaaacttagacatgattaggtcatacattctcaggggttcaaatttccttctaccattcaaatgttttatcaacagcaaacttcagccgtttcactttttgttggagaaaaatagtagattttaatttgactcacagtttgaagcattctgtgatcccctggttactgagttaaaaaataaaaaagtacgagttagacatatgaaatggttatgaacgcttttgtgctgctgatttttaatgctgtaaagttttcctgtgtttagcttgttgaaatgttttgcatctgtcaattaaggaaaaaaaaaatcactctatgttgccccactttagagccctgtgtgccaccctgtgttcctgtgattgcaatgtgagaccgaatgtaatatggaaaacctaccagtggggtgtggttgtgccctgagcacgtgtgtaaaggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaagaaaatatgcttaacagagaggaaaaaaatgtggtttggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcttttttcttttatattacgtgaagtgatgaaatttagaatgacctctaacactcctgtaattgtcttttaaaatactgatatttttatttgttaataatactttgccctcagaaagattctgataccctgccttgacaacatgaaacttgaggctgctttggttcatgaatccaggtgttcccccggcagtcggcttcttcagtcgctccctggaggcaggtgggcactgcagaggatcactggaatccagatcgagcgcagttcatgcacaaggccccgttgatttaaaatattggatcttgctctgttagggtgtctaatccctttacacaagattgaagccaccaaactgagaccttgatacctttttttaactgcatctgaaattatgttaagagtctttaacccatttgcattatctgcagaagagaaactcatgtcatgtttattacctatatggttgttttaattacatttgaataattatatttttccaaccactgattacttttcaggaatttaattatttccagataaatttctttattttatattgtacatgaaaagttttaaagatatgtttaagaccaagactattaaaatgatttttaaagttgttggagacgccaatagcaatatctaggaaatttgcattgagaccattgtattttccactagcagtgaaaatgatttttcacaactaacttgtaaatatattttaatcattacttctttttttctagtccatttttatttggacatcaaccacagacaatttaaattttatagatgcactaagaattcactgcagcagcaggttacatagcaaaaatgcaaaggtgaacaggaagtaaatttctggcttttctgctgtaaatagtgaaggaaaattactaaaatcaagtaaaactaatgcatattatttgattgacaataaaatatttaccatcacatgctgcagctgttttttaaggaacatgatgtcattcattcatacagtaatcatgctgcagaaatttgcagtctgcaccttatggatcacaattacctttagttgttttttttgtaataattgtagccaagtaaatctccaataaagttatcgtctgttcaaaaaaaaacgacaccatctcaatacagacgaaaacgcgcagacataaaataaggggggggcgataaatatcaacacagaggggcactcacggcacctgtttgaacggaggccgcaacagaggttaacaaggcggcgcctaatatttggagaaaactaccgttggagaacacatgcgcgcg

SEQ ID NO: 437122 - DNA, 10125 bp, Homo sapiens
ggaaactctgaaagaacttagaatcagcattttgagagcagaagcttgggcatgctgtgattttccaataaactgctatcacaatgtcaaaatgcagttcagacaagagcaacacagagatctcaaacattaaaacgtaagctgtgctagaacaaaaatgcaatgaaagaaacactggatgaatgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaagacatttattgctagtactactctactaaagagctgtctctatctagatctaggggagacttcagctagaaatggaaaaaggacggtgttcttggtcaactctgcaaaccaggttgctcaacaagtgtcagctgtcagaactcattcagatctcaaggttggggaatactcaaacctagaagtaaatgcatcttggacaaaagagagatggaaccaagagtttactaagcaccaggttctcattatgacttgctatgtcgccttgaatgttttgaaaaatggttacttatcactgtcagacattaaccttttggtgtttgatgagtgtcatcttgcaatcctagaccacccctatcgagaatttatgaagctctgtgaaatttgtccatcatgtcctcgcattttgggactaactgcttccattttaaatgggaaatgggatccagaggatttggaagaaaagtttcagaaactagagaaaattcttaagagtaatgctgaaactgcaactgacctggtggtcttagacaggtatacttctcagccatgtgagattgtggtggattgtggaccatttactgacagaagtgggctttatgaaagactgctgatggaattagaagaagcacttaattttatcaatgattgtaatatatctgtacattcaaaagaaagagattctactttaatttcgaaacagatactatcagactgtcgtgccgtattggtagttctgggaccctggtgtgcagataaagtagctggaatgatggtaagagaactacagaaatacatcaaacatgagcaagaggagctgcacaggaaatttttattgtttacagacactttcctaaggaaaatacatgcactatgtgaagagcacttctcacctgcctcacttgacctgaaatttgtaactcctaaagtaatcaaactgctcgaaatcttacgcaaatataaaccatatgagcgacacagttttgaaagcgttgagtggtataataatagaaatcaggataattatgtgtcatggagtgattctgaggatgatgatgaggatgaagaaattgaagaaaaagagaagccagagacaaattttccttctccttttaccaacattttgtgcggaattatttttgtggaaagaagatacacagcagttgtcttaaacagattgataaaggaagctggcaaacaagatccagagctggcttatatcagtagcaatttcataactggacatggcattgggaagaatcagcctcgcaacaaacacgatggaagcagaattcagaaaacaggaagaggtacttaggaaatttcgagcacatgagaccaacctgcttattgcaacaagtattgtagaagagggtgttgatataccaaaatgcaacttggtggttcgttttgatttgcccacagaatatcgatcctatgttcaatctaaaggaagagcaagggcacccatctctaattatataatgttagcggatacagacaaaataaaaagttttgaagaagaccttaaaacctacaaagctattgaaaagatcttgagaaacaagtgttccaagtcggttgatactggtgagactgacattgatcctgtcatggatgatgatgacgttttcccaccatatgtgttgaggcctgacgatggtggtccacgagtcacaatcaacacggccattggacacatcaatagatactgtgctagattaccaagtgatccgtttactcatctagctcctaaatgcagaacccgagagttgcctgatggtacattttattcaactctttatctgccaattaactcacctcttcgagcctccattgttggtccaccaatgagctgtgtacgattggctgaaagagttgtagctctcatttgctgtgagaaactgcacaaaattggcgaactggatgaccatttgatgccagttgggaaagagactgttaaatatgaagaggagcttgatttgcatgatgaagaagagaccagtgttccaggaagaccaggttccacgaaacgaaggcagtgctacccaaaagcaattccagagtgtttgagggatagttatcccagacctgatcagccctgttacctgtatgtgataggaatggttttaactacacctttacctgatgaactcaactttagaaggcggaagctctatcctcctgaagataccacaagatgctttggaatactgacggccaaacccatacctcagattccacactttcctgtgtacacacgctctggagaggttaccatatccattgagttgaagaagtctggtttcatgttgtctctacaaatgcttgagttgattacaagacttcaccagtatatattctcacatattcttcggcttgaaaaacctgcactagaatttaaacctacagacgctgattcagcatactgtgttctacctcttaatgttgttaatgactccagcactttggatattgactttaaattcatggaagatattgagaagtctgaagctcgcataggcattcccagtacaaagtatacaaaagaaacaccctttgtttttaaattagaagattaccaagatgccgttatcattccaagatatcgcaattttgatcagcctcatcgattttatgtagctgatgtgtacactgatcttaccccactcagtaaatttccttcccctgagtatgaaacttttgcagaatattataaaacaaagtacaaccttgacctaaccaatctcaaccagccactgctggatgtggaccacacatcttcaagacttaatcttttgacacctcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttagataccctaacttagacttcgggtggaaaaaatctattgacagcaaatctttcatctcaatttctaactcctcttcagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagaatttatacagttacgagaaccagccccagcccagcgatgaatgtactctcctgagtaataaataccttgatggaaatgctaacaaatctacctcagatggaagtcctgtgatggccgtaatgcctggtacgacagacactattcaagtgctcaagggcaggatggattctgagcagagcccttctattgggtactcctcaaggactcttggccccaatcctggacttattcttcaggctttgactctgtcaaacgctagtgatggatttaacctggagcggcttgaaatgcttggcgactcctttttaaagcatgccatcaccacatatctattttgcacttaccctgatgcgcatgagggccgcctttcatatatgagaagcaaaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatgacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactgattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaatagaaaagttttctgcaaatgtaccccgttcccctgtgcgagaattgcttgaaatggaaccagaaactgccaaatttagcccggctgagagaacttacgacgggaaggtcagagtcactgtggaagtagtaggaaaggggaaatttaaaggtgttggtcgaagttacaggattgccaaatctgcagcagcaagaagagccctccgaagcctcaaagctaatcaacctcaggttcccaatagctgaaaccgctttttaaaattcaaaacaagaaacaaaacaaaaaaaattaaggggaaaattatttaaatcggaaaggaagacttaaagttgatagtgagtggaatgaattgaaggcagaatttaaagtttggttgataacaggatagataacagaataaaacatttaacatatgtataaaattttggaactaattgtagttttagttttttgcgcaaacacaatcttatcttctttcctcacttctgctttgtttaaatcacaagagtgctttaatgatgacatttagcaagtgctcaaaataattgacaggttttgtttttttttttttgagtttatgtcagctttgcttagtgttagaaggccatggagcttaaacctccagcagtccctaggatgatgtagattcttctccatctctccgtgtgtgcagtagtgccagtcctgcagtagttgataagctgaatagaaagataaggttttcgagaggagaagtgcgccaatgttgtcttttctttccacgttatactgtgtaaggtgatgttcccggtcgctgttgcacctgatagtaagggacagatttttaatgaacattggctggcatgttggtgaatcacattttagttttctgatgccacatagtcttgcataaaaaagggttcttgccttaaaagtgaaaccttcatggatagtctttaatctctgatctttttggaacaaactgttttacattcctttcattttattatgcattagacgttgagacagcgtgatacttacaactcactagtatagttgtaacttattacaggatcatactaaaatttctgtcatatgtatactgaagacattttaaaaaccagaatatgtagtctacggatattttttatcataaaaatgatctttggctaaacaccccattttactaaagtcctcctgccaggtagttcccactgatggaaatgtttatggcaaataattttgccttctaggctgttgctctaacaaaataaaccttagacatatcacacctaaaatatgctgcagattttataattgattggttacttatttaagaagcaaaacacagcacctttacccttagtctcctcacataaatttcttactatacttttcataatgttgcatgcatatttcacctaccaaagctgtgctgttaatgccgtgaaagtttaacgtttgcgataaactgccgtaattttgatacatctgtgatttaggtcattaatttagataaactagctcattatttccatctttggaaaaggaaaaaaaaaaaaacttctttaggcatttgcctaagtttctttaattagacttgtaggcactcttcacttaaatacctcagttcttcttttcttttgcatgcatttttcccctgtttggtgctatgtttatgtattatgcttgaaattttaattttttttttttttgcactgtaactataatacctcttaatttacctttttaaaagctgtgggtcagtcttgcactcccatcaacataccagtagaggtttgctgcaatttgccccgttaattatgcttgaagtttaagaaagctgagcagaggtgtctcatatttcccagcacatgattctgaacttgatgcttcatggaatgctgcatttatatgtaagtgacatttgaatactgtccttcctgctttatctgcatcatccacccacagagaaatgcctctgtgcgagtgcaccgacagaaaactgtcagctctgctttctaaggaaccctgagtgaggggggtattaagcttctccagtgttttttgttgtctccaatcttaaacttaaattgagatctaaattattaaacgagtttttgagcaaattaggtgacttgttttaaaaatatttaattccgatttggaaccttagatgtctatttgattttttaaaaaaccttaatgtaagatatgaccagttaaaacaaagcaattcttgaattatataactgtaaaagtgtgcagttaacaaggctggatgtgaattttattctgagggtgatttgtgatcaagtttaatcacaaatctcttaatatttataaactacctgatgccaggagcttagggctttgcattgtgtctaatacattgatcccagtgttacgggattctcttgattcctggcaccaaaatcagattgttttcacagttatgattcccagtgggagaaaaatgcctcaatatatttgtaaccttaagaagagtatttttttgttaatactaagatgttcaaacttagacatgattaggtcatacattctcaggggttcaaatttccttctaccattcaaatgttttatcaacagcaaacttcagccgtttcactttttgttggagaaaaatagtagattttaatttgactcacagtttgaagcattctgtgatcccctggttactgagttaaaaaataaaaaagtacgagttagacatatgaaatggttatgaacgcttttgtgctgctgatttttaatgctgtaaagttttcctgtgtttagcttgttgaaatgttttgcatctgtcaattaaggaaaaaaaaaatcactctatgttgccccactttagagccctgtgtgccaccctgtgttcctgtgattgcaatgtgagaccgaatgtaatatggaaaacctaccagtggggtgtggttgtgccctgagcacgtgtgtaaaggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaagaaaatatgcttaacagagaggaaaaaaatgtggtttggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcttttttcttttatattacgtgaagtgatgaaatttagaatgacctctaacactcctgtaattgtcttttaaaatactgatatttttatttgttaataatactttgccctcagaaagattctgataccctgccttgacaacatgaaacttgaggctgctttggttcatgaatccaggtgttcccccggcagtcggcttcttcagtcgctccctggaggcaggtgggcactgcagaggatcactggaatccagatcgagcgcagttcatgcacaaggccccgttgatttaaaatattggatcttgctctgttagggtgtctaatccctttacacaagattgaagccaccaaactgagaccttgatacctttttttaactgcatctgaaattatgttaagagtctttaacccatttgcattatctgcagaagagaaactcatgtcatgtttattacctatatggttgttttaattacatttgaataattatatttttccaaccactgattacttttcaggaatttaattatttccagataaatttctttattttatattgtacatgaaaagttttaaagatatgtttaagaccaagactattaaaatgatttttaaagttgttggagacgccaatagcaatatctaggaaatttgcattgagaccattgtattttccactagcagtgaaaatgatttttcacaactaacttgtaaatatattttaatcattacttctttttttctagtccatttttatttggacatcaaccacagacaatttaaattttatagatgcactaagaattcactgcagcagcaggttacatagcaaaaatgcaaaggtgaacaggaagtaaatttctggcttttctgctgtaaatagtgaaggaaaattactaaaatcaagtaaaactaatgcatattatttgattgacaataaaatatttaccatcacatgctgcagctgttttttaaggaacatgatgtctcagtatgggagggatactctaga

SEQ ID NO: 437123 - DNA, 10175 bp, Homo sapiens
ggaaactctgaaagaacttagaatcagcattttgagagcagaagcttgggcatgctgtgattttccaataaactgctatcacaatgtcaaaatgcagttcagacaagagcaacacagagatctcaaacattaaaacgtaagctgtgctagaacaaaaatgcaatgaaagaaacactggatgaatgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaagacatttattgctagtactactctactaaagagctgtctctatctagatctaggggagacttcagctagaaatggaaaaaggacggtgttcttggtcaactctgcaaaccaggttgctcaacaagtgtcagctgtcagaactcattcagatctcaaggttggggaatactcaaacctagaagtaaatgcatcttggacaaaagagagatggaaccaagagtttactaagcaccaggttctcattatgacttgctatgtcgccttgaatgttttgaaaaatggttacttatcactgtcagacattaaccttttggtgtttgatgagtgtcatcttgcaatcctagaccacccctatcgagaatttatgaagctctgtgaaatttgtccatcatgtcctcgcattttgggactaactgcttccattttaaatgggaaatgggatccagaggatttggaagaaaagtttcagaaactagagaaaattcttaagagtaatgctgaaactgcaactgacctggtggtcttagacaggtatacttctcagccatgtgagattgtggtggattgtggaccatttactgacagaagtgggctttatgaaagactgctgatggaattagaagaagcacttaattttatcaatgattgtaatatatctgtacattcaaaagaaagagattctactttaatttcgaaacagatactatcagactgtcgtgccgtattggtagttctgggaccctggtgtgcagataaagtagctggaatgatggtaagagaactacagaaatacatcaaacatgagcaagaggagctgcacaggaaatttttattgtttacagacactttcctaaggaaaatacatgcactatgtgaagagcacttctcacctgcctcacttgacctgaaatttgtaactcctaaagtaatcaaactgctcgaaatcttacgcaaatataaaccatatgagcgacacagttttgaaagcgttgagtggtataataatagaaatcaggataattatgtgtcatggagtgattctgaggatgatgatgaggatgaagaaattgaagaaaaagagaagccagagacaaattttccttctccttttaccaacattttgtgcggaattatttttgtggaaagaagatacacagcagttgtcttaaacagattgataaaggaagctggcaaacaagatccagagctggcttatatcagtagcaatttcataactggacatggcattgggaagaatcagcctcgcaacaaacacgatggaagcagaattcagaaaacaggaagaggtacttaggaaatttcgagcacatgagaccaacctgcttattgcaacaagtattgtagaagagggtgttgatataccaaaatgcaacttggtggttcgttttgatttgcccacagaatatcgatcctatgttcaatctaaaggaagagcaagggcacccatctctaattatataatgttagcggatacagacaaaataaaaagttttgaagaagaccttaaaacctacaaagctattgaaaagatcttgagaaacaagtgttccaagtcggttgatactggtgagactgacattgatcctgtcatggatgatgatgacgttttcccaccatatgtgttgaggcctgacgatggtggtccacgagtcacaatcaacacggccattggacacatcaatagatactgtgctagattaccaagtgatccgtttactcatctagctcctaaatgcagaacccgagagttgcctgatggtacattttattcaactctttatctgccaattaactcacctcttcgagcctccattgttggtccaccaatgagctgtgtacgattggctgaaagagttgtagctctcatttgctgtgagaaactgcacaaaattggcgaactggatgaccatttgatgccagttgggaaagagactgttaaatatgaagaggagcttgatttgcatgatgaagaagagaccagtgttccaggaagaccaggttccacgaaacgaaggcagtgctacccaaaagcaattccagagtgtttgagggatagttatcccagacctgatcagccctgttacctgtatgtgataggaatggttttaactacacctttacctgatgaactcaactttagaaggcggaagctctatcctcctgaagataccacaagatgctttggaatactgacggccaaacccatacctcagattccacactttcctgtgtacacacgctctggagaggttaccatatccattgagttgaagaagtctggtttcatgttgtctctacaaatgcttgagttgattacaagacttcaccagtatatattctcacatattcttcggcttgaaaaacctgcactagaatttaaacctacagacgctgattcagcatactgtgttctacctcttaatgttgttaatgactccagcactttggatattgactttaaattcatggaagatattgagaagtctgaagctcgcataggcattcccagtacaaagtatacaaaagaaacaccctttgtttttaaattagaagattaccaagatgccgttatcattccaagatatcgcaattttgatcagcctcatcgattttatgtagctgatgtgtacactgatcttaccccactcagtaaatttccttcccctgagtatgaaacttttgcagaatattataaaacaaagtacaaccttgacctaaccaatctcaaccagccactgctggatgtggaccacacatcttcaagacttaatcttttgacacctcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttagataccctaacttagacttcgggtggaaaaaatctattgacagcaaatctttcatctcaatttctaactcctcttcagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagaatttatacagttacgagaaccagccccagcccagcgatgaatgtactctcctgagtaataaataccttgatggaaatgctaacaaatctacctcagatggaagtcctgtgatggccgtaatgcctggtacgacagacactattcaagtgctcaagggcaggatggattctgagcagagcccttctattgggtactcctcaaggactcttggccccaatcctggacttattcttcaggctttgactctgtcaaacgctagtgatggatttaacctggagcggcttgaaatgcttggcgactcctttttaaagcatgccatcaccacatatctattttgcacttaccctgatgcgcatgagggccgcctttcatatatgagaagcaaaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatgacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactgattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaatagaaaagttttctgcaaatgtaccccgttcccctgtgcgagaattgcttgaaatggaaccagaaactgccaaatttagcccggctgagagaacttacgacgggaaggtcagagtcactgtggaagtagtaggaaaggggaaatttaaaggtgttggtcgaagttacaggattgccaaatctgcagcagcaagaagagccctccgaagcctcaaagctaatcaacctcaggttcccaatagctgaaaccgctttttaaaattcaaaacaagaaacaaaacaaaaaaaattaaggggaaaattatttaaatcggaaaggaagacttaaagttgatagtgagtggaatgaattgaaggcagaatttaaagtttggttgataacaggatagataacagaataaaacatttaacatatgtataaaattttggaactaattgtagttttagttttttgcgcaaacacaatcttatcttctttcctcacttctgctttgtttaaatcacaagagtgctttaatgatgacatttagcaagtgctcaaaataattgacaggttttgtttttttttttttgagtttatgtcagctttgcttagtgttagaaggccatggagcttaaacctccagcagtccctaggatgatgtagattcttctccatctctccgtgtgtgcagtagtgccagtcctgcagtagttgataagctgaatagaaagataaggttttcgagaggagaagtgcgccaatgttgtcttttctttccacgttatactgtgtaaggtgatgttcccggtcgctgttgcacctgatagtaagggacagatttttaatgaacattggctggcatgttggtgaatcacattttagttttctgatgccacatagtcttgcataaaaaagggttcttgccttaaaagtgaaaccttcatggatagtctttaatctctgatctttttggaacaaactgttttacattcctttcattttattatgcattagacgttgagacagcgtgatacttacaactcactagtatagttgtaacttattacaggatcatactaaaatttctgtcatatgtatactgaagacattttaaaaaccagaatatgtagtctacggatattttttatcataaaaatgatctttggctaaacaccccattttactaaagtcctcctgccaggtagttcccactgatggaaatgtttatggcaaataattttgccttctaggctgttgctctaacaaaataaaccttagacatatcacacctaaaatatgctgcagattttataattgattggttacttatttaagaagcaaaacacagcacctttacccttagtctcctcacataaatttcttactatacttttcataatgttgcatgcatatttcacctaccaaagctgtgctgttaatgccgtgaaagtttaacgtttgcgataaactgccgtaattttgatacatctgtgatttaggtcattaatttagataaactagctcattatttccatctttggaaaaggaaaaaaaaaaaaacttctttaggcatttgcctaagtttctttaattagacttgtaggcactcttcacttaaatacctcagttcttcttttcttttgcatgcatttttcccctgtttggtgctatgtttatgtattatgcttgaaattttaattttttttttttttgcactgtaactataatacctcttaatttacctttttaaaagctgtgggtcagtcttgcactcccatcaacataccagtagaggtttgctgcaatttgccccgttaattatgcttgaagtttaagaaagctgagcagaggtgtctcatatttcccagcacatgattctgaacttgatgcttcatggaatgctgcatttatatgtaagtgacatttgaatactgtccttcctgctttatctgcatcatccacccacagagaaatgcctctgtgcgagtgcaccgacagaaaactgtcagctctgctttctaaggaaccctgagtgaggggggtattaagcttctccagtgttttttgttgtctccaatcttaaacttaaattgagatctaaattattaaacgagtttttgagcaaattaggtgacttgttttaaaaatatttaattccgatttggaaccttagatgtctatttgattttttaaaaaaccttaatgtaagatatgaccagttaaaacaaagcaattcttgaattatataactgtaaaagtgtgcagttaacaaggctggatgtgaattttattctgagggtgatttgtgatcaagtttaatcacaaatctcttaatatttataaactacctgatgccaggagcttagggctttgcattgtgtctaatacattgatcccagtgttacgggattctcttgattcctggcaccaaaatcagattgttttcacagttatgattcccagtgggagaaaaatgcctcaatatatttgtaaccttaagaagagtatttttttgttaatactaagatgttcaaacttagacatgattaggtcatacattctcaggggttcaaatttccttctaccattcaaatgttttatcaacagcaaacttcagccgtttcactttttgttggagaaaaatagtagattttaatttgactcacagtttgaagcattctgtgatcccctggttactgagttaaaaaataaaaaagtacgagttagacatatgaaatggttatgaacgcttttgtgctgctgatttttaatgctgtaaagttttcctgtgtttagcttgttgaaatgttttgcatctgtcaattaaggaaaaaaaaaatcactctatgttgccccactttagagccctgtgtgccaccctgtgttcctgtgattgcaatgtgagaccgaatgtaatatggaaaacctaccagtggggtgtggttgtgccctgagcacgtgtgtaaaggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaagaaaatatgcttaacagagaggaaaaaaatgtggtttggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcttttttcttttatattacgtgaagtgatgaaatttagaatgacctctaacactcctgtaattgtcttttaaaatactgatatttttatttgttaataatactttgccctcagaaagattctgataccctgccttgacaacatgaaacttgaggctgctttggttcatgaatccaggtgttcccccggcagtcggcttcttcagtcgctccctggaggcaggtgggcactgcagaggatcactggaatccagatcgagcgcagttcatgcacaaggccccgttgatttaccaccaaactgagaccttgatacctttttttaactgcatctgaaattatgttaagagtctttaacccatttgcattatctgcagaagagaaactcatgtcatgtttattacctatatggttgttttaattacatttgaataattatatttttccaaccactgattacttttcaggaatttaattatttccagataaatttctttattttatattgtacatgaaaagttttaaagatatgtttaagaccaagactattaaaatgatttttaaagttgttggagacgccaatagcaatatctaggaaatttgcattgagaccattgtattttccactagcagtgaaaatgatttttcacaactaacttgtaaatatattttaatcattacttctttttttctagtccatttttatttggacatcaaccacagacaatttaaattttatagatgcactaagaattcactgcagcagcaggttacatagcaaaaatgcaaaggtgaacaggaagtaaatttctggcttttctgctgtaaatagtgaaggaaaattactaaaatcaagtaaaactaatgcatattatttgattgacaataaaatatttaccatcacatgctgcagctgttttttaaggaacatgatgtcattcattcatacagtaatcatgctgcagaaatttgcagtctgcaccttatggatcacaattacctttagttgttttttttgtaataattgtagccaagtaaatctccaataaagttatcgtctgttca

SEQ ID NO: 437124 - DNA, 9263 bp, Homo sapiens
ggaaactctgaaagaacttagaatcagcattttgagagcagaagcttgggcatgctgtgattttccaataaactgctatcacaatgtcaaaatgcagttcagacaagagcaacacagagatctcaaacattaaaacgtaagctgtgctagaacaaaaatgcaatgaaagaaacactggatgaatgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaagacatttattgctagtactactctactaaagagctgtctctatctagatctaggggagacttcagctagaaatggaaaaaggacggtgttcttggtcaactctgcaaaccaggttgctcaacaagtgtcagctgtcagaactcattcagatctcaaggttggggaatactcaaacctagaagtaaatgcatcttggacaaaagagagatggaaccaagagtttactaagcaccaggttctcattatgacttgctatgtcgccttgaatgttttgaaaaatggttacttatcactgtcagacattaaccttttggtgtttgatgagtgtcatcttgcaatcctagaccacccctatcgagaatttatgaagctctgtgaaatttgtccatcatgtcctcgcattttgggactaactgcttccattttaaatgggaaatgggatccagaggatttggaagaaaagtttcagaaactagagaaaattcttaagagtaatgctgaaactgcaactgacctggtggtcttagacaggtatacttctcagccatgtgagattgtggtggattgtggaccatttactgacagaagtgggctttatgaaagactgctgatggaattagaagaagcacttaattttatcaatgattgtaatatatctgtacattcaaaagaaagagattctactttaatttcgaaacagatactatcagactgtcgtgccgtattggtagttctgggaccctggtgtgcagataaagtagctggaatgatggtaagagaactacagaaatacatcaaacatgagcaagaggagctgcacaggaaatttttattgtttacagacactttcctaaggaaaatacatgcactatgtgaagagcacttctcacctgcctcacttgacctgaaatttgtaactcctaaagtaatcaaactgctcgaaatcttacgcaaatataaaccatatgagcgacacagttttgaaagcgttgagtggtataataatagaaatcaggataattatgtgtcatggagtgattctgaggatgatgatgaggatgaagaaattgaagaaaaagagaagccagagacaaattttccttctccttttaccaacattttgtgcggaattatttttgtggaaagaagatacacagcagttgtcttaaacagattgataaaggaagctggcaaacaagatccagagctggcttatatcagtagcaatttcataactggacatggcattgggaagaatcagcctcgcaacaaacacgatggaagcagaattcagaaaacaggaagaggtacttaggaaatttcgagcacatgagaccaacctgcttattgcaacaagtattgtagaagagggtgttgatataccaaaatgcaacttggtggttcgttttgatttgcccacagaatatcgatcctatgttcaatctaaaggaagagcaagggcacccatctctaattatataatgttagcggatacagacaaaataaaaagttttgaagaagaccttaaaacctacaaagctattgaaaagatcttgagaaacaagtgttccaagtcggttgatactggtgagactgacattgatcctgtcatggatgatgatgacgttttcccaccatatgtgttgaggcctgacgatggtggtccacgagtcacaatcaacacggccattggacacatcaatagatactgtgctagattaccaagtgatccgtttactcatctagctcctaaatgcagaacccgagagttgcctgatggtacattttattcaactctttatctgccaattaactcacctcttcgagcctccattgttggtccaccaatgagctgtgtacgattggctgaaagagttgtagctctcatttgctgtgagaaactgcacaaaattggcgaactggatgaccatttgatgccagttgggaaagagactgttaaatatgaagaggagcttgatttgcatgatgaagaagagaccagtgttccaggaagaccaggttccacgaaacgaaggcagtgctacccaaaagcaattccagagtgtttgagggatagttatcccagacctgatcagccctgttacctgtatgtgataggaatggttttaactacacctttacctgatgaactcaactttagaaggcggaagctctatcctcctgaagataccacaagatgctttggaatactgacggccaaacccatacctcagattccacactttcctgtgtacacacgctctggagaggttaccatatccattgagttgaagaagtctggtttcatgttgtctctacaaatgcttgagttgattacaagacttcaccagtatatattctcacatattcttcggcttgaaaaacctgcactagaatttaaacctacagacgctgattcagcatactgtgttctacctcttaatgttgttaatgactccagcactttggatattgactttaaattcatggaagatattgagaagtctgaagctcgcataggcattcccagtacaaagtatacaaaagaaacaccctttgtttttaaattagaagattaccaagatgccgttatcattccaagatatcgcaattttgatcagcctcatcgattttatgtagctgatgtgtacactgatcttaccccactcagtaaatttccttcccctgagtatgaaacttttgcagaatattataaaacaaagtacaaccttgacctaaccaatctcaaccagccactgctggatgtggaccacacatcttcaagacttaatcttttgacacctcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttagataccctaacttagacttcgggtggaaaaaatctattgacagcaaatctttcatctcaatttctaactcctcttcagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagaatttatacagttacgagaaccagccccagcccagcgatgaatgtactctcctgagtaataaataccttgatggaaatgctaacaaatctacctcagatggaagtcctgtgatggccgtaatgcctggtacgacagacactattcaagtgctcaagggcaggatggattctgagcagagcccttctattgggtactcctcaaggactcttggccccaatcctggacttattcttcaggctttgactctgtcaaacgctagtgatggatttaacctggagcggcttgaaatgcttggcgactcctttttaaagcatgccatcaccacatatctattttgcacttaccctgatgcgcatgagggccgcctttcatatatgagaagcaaaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatgacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactgattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaatagaaaagttttctgcaaatgtaccccgttcccctgtgcgagaattgcttgaaatggaaccagaaactgccaaatttagcccggctgagagaacttacgacgggaaggtcagagtcactgtggaagtagtaggaaaggggaaatttaaaggtgttggtcgaagttacaggattgccaaatctgcagcagcaagaagagccctccgaagcctcaaagctaatcaacctcaggttcccaatagctgaaaccgctttttaaaattcaaaacaagaaacaaaacaaaaaaaattaaggggaaaattatttaaatcggaaaggaagacttaaagttgatagtgagtggaatgaattgaaggcagaatttaaagtttggttgataacaggatagataacagaataaaacatttaacatatgtataaaattttggaactaattgtagttttagttttttgcgcaaacacaatcttatcttctttcctcacttctgctttgtttaaatcacaagagtgctttaatgatgacatttagcaagtgctcaaaataattgacaggttttgtttttttttttttgagtttatgtcagctttgcttagtgttagaaggccatggagcttaaacctccagcagtccctaggatgatgtagattcttctccatctctccgtgtgtgcagtagtgccagtcctgcagtagttgataagctgaatagaaagataaggttttcgagaggagaagtgcgccaatgttgtcttttctttccacgttatactgtgtaaggtgatgttcccggtcgctgttgcacctgatagtaagggacagatttttaatgaacattggctggcatgttggtgaatcacattttagttttctgatgccacatagtcttgcataaaaaagggttcttgccttaaaagtgaaaccttcatggatagtctttaatctctgatctttttggaacaaactgttttacattcctttcattttattatgcattagacgttgagacagcgtgatacttacaactcactagtatagttgtaacttattacaggatcatactaaaatttctgtcatatgtatactgaagacattttaaaaaccagaatatgtagtctacggatattttttatcataaaaatgatctttggctaaacaccccattttactaaagtcctcctgccaggtagttcccactgatggaaatgtttatggcaaataattttgccttctaggctgttgctctaacaaaataaaccttagacatatcacacctaaaatatgctgcagattttataattgattggttacttatttaagaagcaaaacacagcacctttacccttagtctcctcacataaatttcttactatacttttcataatgttgcatgcatatttcacctaccaaagctgtgctgttaatgccgtgaaagtttaacgtttgcgataaactgccgtaattttgatacatctgtgatttaggtcattaatttagataaactagctcattatttccatctttggaaaaggaaaaaaaaaaaaacttctttaggcatttgcctaagtttctttaattagacttgtaggcactcttcacttaaatacctcagttcttcttttcttttgcatgcatttttcccctgtttggtgctatgtttatgtattatgcttgaaattttaattttttttttttttgcactgtaactataatacctcttaatttacctttttaaaagctgtgggtcagtcttgcactcccatcaacataccagtagaggtttgctgcaatttgccccgttaattatgcttgaagtttaagaaagctgagcagaggtgtctcatatttcccagcacatgattctgaacttgatgcttcatggaatgctgcatttatatgtaagtgacatttgaatactgtccttcctgctttatctgcatcatccacccacagagaaatgcctctgtgcgagtgcaccgacagaaaactgtcagctctgctttctaaggaaccctgagtgaggggggtattaagcttctccagtgttttttgttgtctccaatcttaaacttaaattgagatctaaattattaaacgagtttttgagcaaattaggtgacttgttttaaaaatatttaattccgatttggaaccttagatgtctatttgattttttaaaaaaccttaatgtaagatatgaccagttaaaacaaagcaattcttgaattatataactgtaaaagtgtgcagttaacaaggctggatgtgaattttattctgagggtgatttgtgatcaagtttaatcacaaatctcttaatatttataaactacctgatgccaggagcttagggctttgcattgtgtctaatacattgatcccagtgttacgggattctcttgattcctggcaccaaaatcagattgttttcacagttatgattcccagtgggagaaaaatgcctcaatatatttgtaaccttaagaagagtatttttttgttaatactaagatgttcaaacttagacatgattaggtcatacattctcaggggttcaaatttccttctaccattcaaatgttttatcaacagcaaacttcagccgtttcactttttgttggagaaaaatagtagattttaatttgactcacagtttgaagcattctgtgatcccctggttactgagttaaaaaataaaaaagtacgagttagacatatgaaatggttatgaacgcttttgtgctgctgatttttaatgctgtaaagttttcctgtgtttagcttgttgaaatgttttgcatctgtcaattaaggaaaaaaaaaatcactctatgttgccccactttagagccctgtgtgccaccctgtgttcctgtgattgcaatgtgagaccgaatgtaatatggaaaacctaccagtggggtgtggttgtgccctgagcacgtgtgtaaaggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaagaaaatatgcttaacagagaggaaaaaaatgtggtttggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcgacggtcctagtgatcatagatgggatgcgagcagatcgagtataagaggatcacaccgactgggttccgctgcctttggatatctactatctcattctccctgaccagcagtacagctcggacgggagcatgacacctacgtggaca

SEQ ID NO: 437125 - DNA, 7168 bp, Homo sapiens
agaaagggaaaaggaattgacggaagggcaccaccagaaagggcaacaagaagggcaaccttgacctaaccaatctcaaccagccactgctggatgtggaccacacatcttcaagacttaatcttttgacacctcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttagataccctaacttagacttcgggtggaaaaaatctattgacagcaaatctttcatctcaatttctaactcctcttcagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagaatttatacagttacgagaaccagccccagcccagcgatgaatgtactctcctgagtaataaataccttgatggaaatgctaacaaatctacctcagatggaagtcctgtgatggccgtaatgcctggtacgacagacactattcaagtgctcaagggcaggatggattctgagcagagcccttctattgggtactcctcaaggactcttggccccaatcctggacttattcttcaggctttgactctgtcaaacgctagtgatggatttaacctggagcggcttgaaatgcttggcgactcctttttaaagcatgccatcaccacatatctattttgcacttaccctgatgcgcatgagggccgcctttcatatatgagaagcaaaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatgacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactgattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaatagaaaagttttctgcaaatgtaccccgttcccctgtgcgagaattgcttgaaatggaaccagaaactgccaaatttagcccggctgagagaacttacgacgggaaggtcagagtcactgtggaagtagtaggaaaggggaaatttaaaggtgttggtcgaagttacaggattgccaaatctgcagcagcaagaagagccctccgaagcctcaaagctaatcaacctcaggttcccaatagctgaaaccgctttttaaaattcaaaacaagaaacaaaacaaaaaaaattaaggggaaaattatttaaatcggaaaggaagacttaaagttgatagtgagtggaatgaattgaaggcagaatttaaagtttggttgataacaggatagataacagaataaaacatttaacatatgtataaaattttggaactaattgtagttttagttttttgcgcaaacacaatcttatcttctttcctcacttctgctttgtttaaatcacaagagtgctttaatgatgacatttagcaagtgctcaaaataattgacaggttttgtttttttttttttgagtttatgtcagctttgcttagtgttagaaggccatggagcttaaacctccagcagtccctaggatgatgtagattcttctccatctctccgtgtgtgcagtagtgccagtcctgcagtagttgataagctgaatagaaagataaggttttcgagaggagaagtgcgccaatgttgtcttttctttccacgttatactgtgtaaggtgatgttcccggtcgctgttgcacctgatagtaagggacagatttttaatgaacattggctggcatgttggtgaatcacattttagttttctgatgccacatagtcttgcataaaaaagggttcttgccttaaaagtgaaaccttcatggatagtctttaatctctgatctttttggaacaaactgttttacattcctttcattttattatgcattagacgttgagacagcgtgatacttacaactcactagtatagttgtaacttattacaggatcatactaaaatttctgtcatatgtatactgaagacattttaaaaaccagaatatgtagtctacggatattttttatcataaaaatgatctttggctaaacaccccattttactaaagtcctcctgccaggtagttcccactgatggaaatgtttatggcaaataattttgccttctaggctgttgctctaacaaaataaaccttagacatatcacacctaaaatatgctgcagattttataattgattggttacttatttaagaagcaaaacacagcacctttacccttagtctcctcacataaatttcttactatacttttcataatgttgcatgcatatttcacctaccaaagctgtgctgttaatgccgtgaaagtttaacgtttgcgataaactgccgtaattttgatacatctgtgatttaggtcattaatttagataaactagctcattatttccatctttggaaaaggaaaaaaaaaaaaacttctttaggcatttgcctaagtttctttaattagacttgtaggcactcttcacttaaatacctcagttcttcttttcttttgcatgcatttttcccctgtttggtgctatgtttatgtattatgcttgaaattttaattttttttttttttgcactgtaactataatacctcttaatttacctttttaaaagctgtgggtcagtcttgcactcccatcaacataccagtagaggtttgctgcaatttgccccgttaattatgcttgaagtttaagaaagctgagcagaggtgtctcatatttcccagcacatgattctgaacttgatgcttcatggaatgctgcatttatatgtaagtgacatttgaatactgtccttcctgctttatctgcatcatccacccacagagaaatgcctctgtgcgagtgcaccgacagaaaactgtcagctctgctttctaaggaaccctgagtgaggggggtattaagcttctccagtgttttttgttgtctccaatcttaaacttaaattgagatctaaattattaaacgagtttttgagcaaattaggtgacttgttttaaaaatatttaattccgatttggaaccttagatgtctatttgattttttaaaaaaccttaatgtaagatatgaccagttaaaacaaagcaattcttgaattatataactgtaaaagtgtgcagttaacaaggctggatgtgaattttattctgagggtgatttgtgatcaagtttaatcacaaatctcttaatatttataaactacctgatgccaggagcttagggctttgcattgtgtctaatacattgatcccagtgttacgggattctcttgattcctggcaccaaaatcagattgttttcacagttatgattcccagtgggagaaaaatgcctcaatatatttgtaaccttaagaagagtatttttttgttaatactaagatgttcaaacttagacatgattaggtcatacattctcaggggttcaaatttccttctaccattcaaatgttttatcaacagcaaacttcagccgtttcactttttgttggagaaaaatagtagattttaatttgactcacagtttgaagcattctgtgatcccctggttactgagttaaaaaataaaaaagtacgagttagacatatgaaatggttatgaacgcttttgtgctgctgatttttaatgctgtaaagttttcctgtgtttagcttgttgaaatgttttgcatctgtcaattaaggaaaaaaaaaatcactctatgttgccccactttagagccctgtgtgccaccctgtgttcctgtgattgcaatgtgagaccgaatgtaatatggaaaacctaccagtggggtgtggttgtgccctgagcacgtgtgtaaaggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaagaaaatatgcttaacagagaggaaaaaaatgtggtttggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcttttttcttttatattacgtgaagtgatgaaatttagaatgacctctaacactcctgtaattgtcttttaaaatactgatatttttatttgttaataatactttgccctcagaaagattctgataccctgccttgacaacatgaaacttgaggctgctttggttcatgaatccaggtgttcccccggcagtcggcttcttcagtcgctccctggaggcaggtgggcactgcagaggatcactggaatccagatcgagcgcagttcatgcacaaggccccgttgatttaaaatattggatcttgctctgttagggtgtctaatccctttacacaagattgaagccaccaaactgagaccttgatacctttttttaactgcatctgaaattatgttaagagtctttaacccatttgcattatctgcagaagagaaactcatgtcatgtttattacctatatggttgttttaattacatttgaataattatatttttccaaccactgattacttttcaggaatttaattatttccagataaatttctttattttatattgtacatgaaaagttttaaagatatgtttaagaccaagactattaaaatgatttttaaagttgttggagacgccaatagcaatatctaggaaatttgcattgagaccattgtattttccactagcagtgaaaatgatttttcacaactaacttgtaaatatattttaatcattacttctttttttctagtccatttttatttggacatcaaccacagacaatttaaattttatagatgcactaagaattcactgcagcagcaggttacatagcaaaaatgcaaaggtgaacaggaagtaaatttctggcttttctgctgtaaatagtgaaggaaaattactaaaatcaagtaaaactaatgcatattatttgattgacaataaaatatttaccatcacatgctgcagctgttttttaaggaacatgatgtcattcattcatacagtaatcatgctgcagaaatttgcagtctgcaccttatggatcacaattacctttagttgttttttttgtaataattgtagccaagtaaatctccaataaagttatcgtctgttca

SEQ ID NO: 437126 - DNA, 7078 bp, Homo sapiens
ggaaactctgaaagaacttagaatcagcattttgagagcagaagcttgggcatgctgtgattttccaataaactgctatcacaatgtcaaaatgcagttcagacaagagcaacacagagatctcaaacattaaaacgtaagctgtgctagaacaaaaatgcaatgaaagaaacactggatgaatgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaagacatttattgctagtactactctactaaagagctgtctctatctagatctaggggagacttcagctagaaatggaaaaaggacggtgttcttggtcaactctgcaaaccaggttgctcaacaagtgtcagctgtcagaactcattcagatctcaaggttggggaatactcaaacctagaagtaaatgcatcttggacaaaagagagatggaaccaagagtttactaagcaccaggttctcattatgacttgctatgtcgccttgaatgttttgaaaaatggttacttatcactgtcagacattaaccttttggtgtttgatgagtgtcatcttgcaatcctagaccacccctatcgagaatttatgaagctctgtgaaatttgtccatcatgtcctcgcattttgggactaactgcttccattttaaatgggaaatgggatccagaggatttggaagaaaagtttcagaaactagagaaaattcttaagagtaatgctgaaactgcaactgacctggtggtcttagacaggtatacttctcagccatgtgagattgtggtggattgtggaccatttactgacagaagtgggctttatgaaagactgctgatggaattagaagaagcacttaattttatcaatgattgtaatatatctgtacattcaaaagaaagagattctactttaatttcgaaacagatactatcagactgtcgtgccgtattggtagttctgggaccctggtgtgcagataaagtagctggaatgatggtaagagaactacagaaatacatcaaacatgagcaagaggagctgcacaggaaatttttattgtttacagacactttcctaaggaaaatacatgcactatgtgaagagcacttctcacctgcctcacttgacctgaaatttgtaactcctaaagtaatcaaactgctcgaaatcttacgcaaatataaaccatatgagcgacacagttttgaaagcgttgagtggtataataatagaaatcaggataattatgtgtcatggagtgattctgaggatgatgatgaggatgaagaaattgaagaaaaagagaagccagagacaaattttccttctccttttaccaacattttgtgcggaattatttttgtggaaagaagatacacagcagttgtcttaaacagattgataaaggaagctggcaaacaagatccagagctggcttatatcagtagcaatttcataactggacatggcattgggaagaatcagcctcgcaacaaacacgatggaagcagaattcagaaaacaggaagaggtacttaggaaatttcgagcacatgagaccaacctgcttattgcaacaagtattgtagaagagggtgttgatataccaaaatgcaacttggtggttcgttttgatttgcccacagaatatcgatcctatgttcaatctaaaggaagagcaagggcacccatctctaattatataatgttagcggatacagacaaaataaaaagttttgaagaagaccttaaaacctacaaagctattgaaaagatcttgagaaacaagtgttccaagtcggttgatactggtgagactgacattgatcctgtcatggatgatgatgacgttttcccaccatatgtgttgaggcctgacgatggtggtccacgagtcacaatcaacacggccattggacacatcaatagatactgtgctagattaccaagtgatccgtttactcatctagctcctaaatgcagaacccgagagttgcctgatggtacattttattcaactctttatctgccaattaactcacctcttcgagcctccattgttggtccaccaatgagctgtgtacgattggctgaaagagttgtagctctcatttgctgtgagaaactgcacaaaattggcgaactggatgaccatttgatgccagttgggaaagagactgttaaatatgaagaggagcttgatttgcatgatgaagaagagaccagtgttccaggaagaccaggttccacgaaacgaaggcagtgctacccaaaagcaattccagagtgtttgagggatagttatcccagacctgatcagccctgttacctgtatgtgataggaatggttttaactacacctttacctgatgaactcaactttagaaggcggaagctctatcctcctgaagataccacaagatgctttggaatactgacggccaaacccatacctcagattccacactttcctgtgtacacacgctctggagaggttaccatatccattgagttgaagaagtctggtttcatgttgtctctacaaatgcttgagttgattacaagacttcaccagtatatattctcacatattcttcggcttgaaaaacctgcactagaatttaaacctacagacgctgattcagcatactgtgttctacctcttaatgttgttaatgactccagcactttggatattgactttaaattcatggaagatattgagaagtctgaagctcgcataggcattcccagtacaaagtatacaaaagaaacaccctttgtttttaaattagaagattaccaagatgccgttatcattccaagatatcgcaattttgatcagcctcatcgattttatgtagctgatgtgtacactgatcttaccccactcagtaaatttccttcccctgagtatgaaacttttgcagaatattataaaacaaagtacaaccttgacctaaccaatctcaaccagccactgctggatgtggaccacacatcttcaagacttaatcttttgacacctcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttagataccctaacttagacttcgggtggaaaaaatctattgacagcaaatctttcatctcaatttctaactcctcttcagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagattttataattgattggttacttatttaagaagcaaaacacagcacctttacccttagtctcctcacataaatttcttactatacttttcataatgttgcatgcatatttcacctaccaaagctgtgctgttaatgccgtgaaagtttaacgtttgcgataaactgccgtaattttgatacatctgtgatttaggtcattaatttagataaactagctcattatttccatctttggaaaaggaaaaaaaaaaaaacttctttaggcatttgcctaagtttctttaattagacttgtaggcactcttcacttaaatacctcagttcttcttttcttttgcatgcatttttcccctgtttggtgctatgtttatgtattatgcttgaaattttaattttttttttttttgcactgtaactataatacctcttaatttacctttttaaaagctgtgggtcagtcttgcactcccatcaacataccagtagaggtttgctgcaatttgccccgttaattatgcttgaagtttaagaaagctgagcagaggtgtctcatatttcccagcacatgattctgaacttgatgcttcatggaatgctgcatttatatgtaagtgacatttgaatactgtccttcctgctttatctgcatcatccacccacagagaaatgcctctgtgcgagtgcaccgacagaaaactgtcagctctgctttctaaggaaccctgagtgaggggggtattaagcttctccagtgttttttgttgtctccaatcttaaacttaaattgagatctaaattattaaacgagtttttgagcaaattaggtgacttgttttaaaaatatttaattccgatttggaaccttagatgtctatttgattttttaaaaaaccttaatgtaagatatgaccagttaaaacaaagcaattcttgaattatataactgtaaaagtgtgcagttaacaaggctggatgtgaattttattctgagggtgatttgtgatcaagtttaatcacaaatctcttaatatttataaactacctgatgccaggagcttagggctttgcattgtgtctaatacattgatcccagtgttacgggattctcttgattcctggcaccaaaatcagattgttttcacagttatgattcccagtgggagaaaaatgcctcaatatatttgtaaccttaagaagagtatttttttgttaatactaagatgttcaaacttagacatgattaggtcatacattctcaggggttcaaatttccttctaccattcaaatgttttatcaacagcaaacttcagccgtttcactttttgttggagaaaaatagtagattttaatttgactcacagtttgaagcattctgtgatcccctggttactgagttaaaaaataaaaaagtacgagttagacatatgaaatggttatgaacgcttttgtgctgctgatttttaatgctgtaaagttttcctgtgtttagcttgttgaaatgttttgcatctgtcaattaaggaaaaaaaaaatcactctatgttgccccactttagagccctgtgtgccaccctgtgttcctgtgattgcaatgtgagaccgaatgtaatatggaaaacctaccagtggggtgtggttgtgccctgagcacgtgtgtaaaggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaagaaaatatgcttaacagagaggaaaaaaatgtggtttggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcttttttcttttatattacgtgaagtgatgaaatttagaatgacctctaacactcctgtaattgtcttttaaaatactgatatttttatttgttaataatactttgccctcagaaagattctgataccctgccttgacaacatgaaacttgaggctgctttggttcatgaatccaggtgttcccccggcagtcggcttcttcagtcgctccctggaggcaggtgggcactgcagaggatcactggaatccagatcgagcgcagttcatgcacaaggccccgttgatttaaaatattggatcttgctctgttagggtgtctaatccctttacacaagattgaagccaccaaactgagaccttgatacctttttttaactgcatctgaaattatgttaagagtctttaacccatttgcattatctgcagaagagaaactcatgtcatgtttattacctatatggttgttttaattacatttgaataattatatttttccaaccactgattacttttcaggaatttaattatttccagataaatttctttattttatattgtacatgaaaagttttaaagatatgtttaagaccaagactattaaaatgatttttaaagttgttggagacgccaatagcaatatctaggaaatttgcattgagaccattgtattttccactagcagtgaaaatgatttttcacaactaacttgtaaatatattttaatcattacttctttttttctagtccatttttatttggacatcaaccacagacaatttaaattttatagatgcactaagaattcactgcagcagcaggttacatagcaaaaatgcaaaggtgaacaggaagtaaatttctggcttttctgctgtaaatagtgaaggaaaattactaaaatcaagtaaaactaatgcatattatttgattgacaataaaatatttaccatcacatgctgcagctgttttttaaggaacatgatgtcattcattcatacagtaatcatgctgcagaaatttgcagtctgcaccttatggatcacaattacctttagttgttttttttgtaataattgtagccaagtaaatctccaataaagttatcgtctgttca

SEQ ID NO: 437127 - DNA, 2044 bp, Homo sapiens
ggaaactctgaaagaacttagaatcagcattttgagagcagaagcttgggcatgctgtgattttccaataaactgctatcacaatgtcaaaatgcagttcagacaagagcaacacagagatctcaaacattaaaacgtaagctgtgctagaacaaaaatgcaatgaaagaaacactggatgaatgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaagacatttattgctagtactactctactaaagagctgtctctatctagatctaggggagacttcagctagaaatggaaaaaggacggtgttcttggtcaactctgcaaaccaggttgctcaacaagtgtcagctgtcagaactcattcagatctcaaggttggggaatactcaaacctagaagtaaatgcatcttggacaaaagagagatggaaccaagagtttactaagcaccaggttctcattatgacttgctatgtcgccttgaatgttttgaaaaatggttacttatcactgtcagacattaaccttttggtgtttgatgagtgtcatcttgcaatcctagaccacccctatcgagaatttatgaagctctgtgaaatttgtccatcatgtcctcgcattttgggactaactgcttccattttaaatgggaaatgggatccagaggatttggaagaaaagtttcagaaactagagaaaattcttaagagtaatgctgaaactgcaactgacctggtggtcttagacaggtatacttctcagccatgtgagattgtggtggattgtggaccatttactgacagaagtgggctttatgaaagactgctgatggaattagaagaagcacttaattttatcaatgattgtaatatatctgtacattcaaaagaaagagattctactttaatttcgaaacagatactatcagactgtcgtgccgtattggtagttctgggaccctggtgtgcagataaagtagctggaatgatggtaagagaactacagaaatacatcaaacatgagcaagaggagctgcacaggaaatttttattgtttacagacactttcctaaggaaaatacatgcactatgtgaagagcacttctcacctgcctcacttgacctgaaatttgtaactcctaaagtaatcaaactgctcgaaatcttacgcaaatataaaccatatgagcgacacagttttgaaagcgttgagtggtataataatagaaatcaggataattatgtgtcatggagtgattctgaggatgatgatgaggatgaagaaattgaagaaaaagagaagccagagacaaattttccttctccttttaccaacattttgtgcggaattatttttgtggaaagaagatacacagcagttgtcttaaacagattgataaaggaagctggcaaacaagatccagagctggcttatatcagtagcaatttcataactggacatggcattgggaagaatcagcctcgcaacaaacacgatggaagcagaattcagaaaacaggaagaggtacttaggaaatttcgagcacatgagaccaacctgcttattgcaacaagtattgtagaagagggtgttgatataccaaaatgcaacttggtggttcgttttgatttgcccacagaatatcgatcctatgttcaatctaaaggaagagcaagggcacccatctctaattatataatgttagcggatacagacaaaataaaaagttttgaagaagaccttaaaacctacaaagctattgaaaagatcttgagaaacaagtgttccaagtcggttgatactggtgagactgacattgatcctgtcatggatgatcgatctgtcctggtgagggtcctcaggcgcaccc

SEQ ID NO: 437128 - DNA, 2975 bp, Homo sapiens
  misc_feature (2)..(5): n is a, c, g, or t
  misc_feature (7)..(8): n is a, c, g, or t
  misc_feature (10)..(10): n is a, c, g, or t
  misc_feature (2165)..(2166): n is a, c, g, or t
  misc_feature (2168)..(2168): n is a, c, g, or t
  misc_feature (2174)..(2174): n is a, c, g, or t
gnnnncnncngccgggaactggaggaaggagaccctggcttcgcaggggccccggctggggcagaggcgaggggcctgggggggcgctggctttggccccgcctggggcaggatggtgaatctggagtccatgcacacagatatcaagatgagtggggatgtagccgattccacggatgctcgcagcactctcagccaggtggagccaggaaatgatcgaaatggcctagatttcaacaggcagattaaaaccgaagatctcagtgactccctgcagcagaccctctcccatcggccatgccacctgagtcaaggacctgccatgatgtccggaaaccaaatgtctgggctaaatgccagcccatgtcaggacatggcttccctccatccgctccagcagcttgtgctggttcccggccacttacagtctgtatcccagttcctgctatctcagacccagcctgggcagcaaggtctgcagccaaatctcctcccctttccacagcaacaaagcggtctcctcctcccacagactgggccgggactggcatcccaggcatttgggcaccctgggctgccaggatcctctttagaaccccacctggaagcatcccagcatctcccagtgcccaagcatctacccagctctggaggggccgatgagcccagtgacctcgaggagctggagaagtttgccaagaccttcaagcagaggcgcattaagctgggcttcacacagggagatgtggggctggcgatgggaaagctgtatggcaacgacttcagccagaccaccatctcacgatttgaggccctcaacctgagcttcaagaacatgtgcaagctcaagcccctgctggagaagtggctgaatgatgcagagtcctctccgtcagacccctcagtgagcacgcccagctcctaccccagcctcagtgaagtatttggtaggaagagaaagaaacggaccagcatcgagaccaacatccgcctgactctggagaagaggtttcaagataacccaaaacccagctcggaggagatctccatgattgcagagcagttgtccatggagaaggaggtggtgagggtctggttctgcaaccgacgccaaaaggagaagcgaatcaactgccctgtggccacacccatcaaaccacctgtctacaactcccggctggtatctccctcagggtctctgggccccctctctgtccctcctgtccacagtaccatgcctggaacagtaacgtcatcctgttcccctgggaacaacagcaggccttcatctcctggctcaggactccacgccagcagccccactgcatctcaaaataactccaaagcagcagtgaactccgcctccagttttaactcttcaggatcttggtaccgatggaatcattccacctacctccactgagaccaaaaagtttctcctactccagctggccctgtattccccctggaaggaagggaatcatgccttctatatacagacagattgccttcagaagagtggaagaaaatctccactatcaatgaacccagactcttgtcttcttcaagagcaagggcctccggagatccaaactgtgattgaaccaagtgcagactcctaatgctcttgaaatacacagcccctcctaggagcttaccattttcaccttccttgcctatgcccttgccttctagttccaaatattttagccagcttcactgtggcaatagtctttcagagaaaagacttcttgctgttattctccaactcatccgtgggcttctggggacagccatttggctggggtgccaaacaccagaaggggagataatagttttgactctgaacttggccacaacccctgaactgatcccaaaatctgtgaaaagatttgaatctgatatctccaccaaagccttgatgttttctctgtacagctaagttttctgatggaatcttcatctcaccccattttctttttaacctcgcccccttttctacaatcaaatccattcattattgcgccctccaggtcccctcctttttgcagaaggtgtaaaagagctgcccttggtgggtgcccttgggcatgttgcaacgcctgctggtgcccttctgtctgtccacgtctgcctagggctcaggagtgcttgttctttccctnncnccctgngtttctctttatcctgtcccctctcctttctcctggcagcagaaaaggaagaacacaagagcaaacacacaacaatgatggtggcaaagtacctgtatatagccctttcccattttttgcattatgttcttaactccttaatgtggaattttccagcaaaatgtttaactcaggtgtgatttttgaaaatgtctctgtaatattttatcttctttaaaaaaaagggggggaaataccaaagtgtgaaatactgtgctaccttccagagttcccacatgggctgggatttttttttctttttcttttttttttttttttttgagacagtcttgctccagcccaggctggagtgcagtggcatgatcttggctcactgcatgctctgccacttgggttcaagcgattctcctgcctcagcctctcaagtagcggattacaggcgcccaccaccaaaaattagcccagctaatttttgtatttttagtagagatggggtttcaccatgttggtcaggctggtcttgaactcctgacctcctgatccacccacctcagcgtcccgaagtgctgggattacaggtgtgagccaccgcgcctggcctgggctgggaatctttgttgacttctttgggaacattatctctagagtctgcttttttgtgggccagtttgtagagatgtaacatgaagccattccagaaatggtaacttaaaaaaaaaaagactacatgtctaggaaactgttgagattcaaaggaatctcactgttcctaaataaatgtgtatagtgattatgaaaagt

SEQ ID NO: 437129 - DNA, 3510 bp, Homo sapiens
  misc_feature (1644)..(1644): n is a, c, g, or t
gaggttttggaaatccagaatccaaacaaaatgcaactctgccttccgcccttagcacctgcacaaatgacagtcactatccttagtttccaaggcacctcagaatattatggtgatgaatgagaccctatttgaatttttaagtgtttattttggttaaaaaataaacatcatactcctggaatggaaaagggaaggtaacagtttaatttgttttcagaagactggagagcgacatgaaaatggcccaggcttataaccacctaggtcagtgtatgatgcagtggtggaaagacacttccaaatttggagtcagaaaaatttactggtttctttaaaaagtcacttactaactgtgtgttttggggaaagttacctaacctctctgagcttccatttcctcttctgaaaaaatgggataatagcaaggctctgcctcatgagattattgagagtcacttgaaataatgcatgtgaaaaggctgtatccatttcaaccgccatgtcagaattgccattagtacccaagcctctcaactcccagttctggattccttgtaagagctttcttgcctatgtattttaataatgaacaatgaagccctgactttttgaaactgaagagcataaaggtcaacatcagcagatgctgtatgtacattgtgacccagaacagcctagggaaaacagagaccccaaagtgctgttgagtgacaagcgattgggatgaccaaccccattgtctgctttggtggtttgatggccccactcctgctgggagagtgagccaccaaccaggcagagtccctcatgtaccgttttcctggggaggatggagaagccggtataatacatactgcccaagggagtttccagaggctcagccctggactttccctcctctctcagccctctctcccaagtataaaatgtcctggtcagccacatgcctctggctaaggcccactgccctttagagccgtatggtcgtatctgcttggtctggcatcctcgcagatttgattgggcctctgtagccataacccagctacttctcctgcagggaaagccaaaatcctcagccctagcttgaattctcagcagccaccctgcatcctttcccttcttggttttcttcagctctggtaatcagatcccagagtagatcgtcttgaccctccttagcctctacgcctctccagacaggcgggcaggtggaaggactggtttggggactgctgtttacatgtctgtttatccctgtatctgatttgcctccacctgtatgtggcaatgcctggcagtgctaggagggcctctccatgggacttgaggtgggtggagggacctgatcaggtggcagggggtggggacagtgatcgtggtgccaaagttgtagcacatgtgtttcaaatagcctggattttatttgtctgttcctttgtccctcccctttcacccaggtctgcagccaaatctcctcccctttccacagcaacaaagcggtctcctcctcccacagactgggccgggactggcatcccaggtaaacaaccccattcttcctgtttcctctaggaatgtctcagctctcactgagtttaactcactggtttccccctacccctttaacagggcactaanccctctggggagaggggatagcagggaactatccattggcacaggggaaatccaagctacagcaagtggggggacaatttaccaagtgtcactggtggggccacagttagaatccagagattccagctcccaggccagcctccttcatgctccaggcactgaactccaaccctgcacaggccccagcattgctcctctgagagccaggctcagctcacttctcaggcataccaagatggccacgaaccctacctaggtgctctcaagccccaagagggagactagaatactacagacctgatgtcccagaccacaaagccagtgtctttcacctctgggccactattccagattgcctcctgcagtgggcacgtatataggccagtgggctgaggtctgggagaggggttgtttgcagagctgccatggttccacacagcaccttttttccaactaggaaaaaggcacctcttctggccaggtgcagtctcatgccaaggtggacagattggcgacagcagcatgagctgtatcttagctgccattcctcccctgatctgggtgcccctgtacagttaataacctgcacagctgcatgagatggctctgcacagatggttgggcagaatggttgggaatgactgcagagatctctgtgctaagatccccatggctcaccaagagcccggccttcagagagggctgaggccactaaaagtacctggaggggaagctcgccatctagtggttgaaatggggacaccagcatcataagctgctcttccgcctcctcctggctgccctctccagaatctcatagccatgggcttacagctggaagagatcttagaatcttcaagatcaactctcatctcttatcatattttggcatggagagactggtagcagagagaccacatagaagattatgaagatcatccaggggaggggtcataaaggattggcttagagttgtggcaataagaagaggggatgattgaggagatgctttgggaagttgaatcagtgcagtttgccagtggattggagatgaaaggaggagggagaaggtctagcagagagccccataagtctttgtcaaatgaaagaacaaatgatttaatgaaaaggaaggttcaaagaggactggggctttgtcctgagggtctggtctatgccacactctcctcacacaccctctccctgcaaactaagaccaaattcatgatggtttcagactaaaagacccttcactgggggaaagactcctaaacttctctctagaggtccttttaccttcttcatcataaggatacctatctgaatggtaaacccaaatatcccagaggagaagaagtaatgtttagtctacaaaaagtaaatcaaaaaggagagaagaggtggatttagccctttgagctagctggccacagtgcctggacccctaggcccagattccactctatccttgtggaatgatagatgtccttaagatcggattcattcctgaccccaaataggcacagcatggttctaggtttaagggtacgttttcctatgaaaataagctcaagaaataatatttggctgggcacggtggctcatacttgtagtcccagcactttgggaggccaaagcaggtagatcacttgagcccaggagtttgagaccagcttgggcaacatggtgaagccctgtctctaaaaaaacaaaagttagccaggtgtggtggcacacgcctgtagccccagctgttcaggagcctgaggcaggagaatgacttaagcccaggaggttgacgctgcagtgagcagtgattgtgccactacactctagcctgggtgacagagtgagatcctgattcaa

SEQ ID NO: 437130 - DNA, 2116 bp, Homo sapiens
  misc_feature (15)..(15): n is a, c, g, or t
  misc_feature (1306)..(1307): n is a, c, g, or t
  misc_feature (1309)..(1309): n is a, c, g, or t
  misc_feature (1315)..(1315): n is a, c, g, or t
tgggtgctagtcgtntccagaggatcccctgtggagggattcggagatgtggggctggcgatgggaaagctgtatggcaacgacttcagccagaccaccatctcacgatttgaggccctcaacctgagcttcaagaacatgtgcaagctcaagcccctgctggagaagtggctgaatgatgcagagtcctctccgtcagacccctcagtgagcacgcccagctcctaccccagcctcagtgaagtatttggtaggaagagaaagaaacggaccagcatcgagaccaacatccgcctgactctggagaagaggtttcaagatgtatctccctcagggtctctgggccccctctctgtccctcctgtccacagtaccatgcctggaacagtaacgtcatcctgttcccctgggaacaacagcaggccttcatctcctggctcaggactccacgccagcagccccactgcatctcaaaataactccaaagcagcagtgaactccgcctccagttttaactcttcaggatcttggtaccgatggaatcattccacctacctccactgagaccaaaaagtttctcctactccagctggccctgtattccccctggaaggaagggaatcatgccttctatatacagacagattgccttcagaagagtggaagaaaatctccactatcaatgaacccagactcttgtcttcttcaagagcaagggcctccggagatccaaactgtgattgaaccaagtgcagactcctaatgctcttgaaatacacagcccctcctaggagcttaccattttcaccttccttgcctatgcccttgccttctagttccaaatattttagccagcttcactgtggcaatagtctttcagagaaaagacttcttgctgttattctccaactcatccgtgggcttctggggacagccatttggctggggtgccaaacaccagaaggggagataatagttttgactctgaacttggccacaacccctgaactgatcccaaaatctgtgaaaagatttgaatctgatatctccaccaaagccttgatgttttctctgtacagctaagttttctgatggaatcttcatctcaccccattttctttttaacctcgcccccttttctacaatcaaatccattcattattgcgccctccaggtcccctcctttttgcagaaggtgtaaaagagctgcccttggtgggtgcccttgggcatgttgcaacgcctgctggtgcccttctgtctgtccacgtctgcctagggctcaggagtgcttgttctttccctnncnccctgngtttctctttatcctgtcccctctcctttctcctggcagcagaaaaggaagaacacaagagcaaacacacaacaatgatggtggcaaagtacctgtatatagccctttcccattttttgcattatgttcttaactccttaatgtggaattttccagcaaaatgtttaactcaggtgtgatttttgaaaatgtctctgtaatattttatcttctttaaaaaaaagggggggaaataccaaagtgtgaaatactgtgctaccttccagagttcccacatgggctgggatttttttttctttttcttttttttttttttttttgagacagtcttgctccagcccaggctggagtgcagtggcatgatcttggctcactgcatgctctgccacttgggttcaagcgattctcctgcctcagcctctcaagtagcggattacaggcgcccaccaccaaaaattagcccagctaatttttgtatttttagtagagatggggtttcaccatgttggtcaggctggtcttgaactcctgacctcctgatccacccacctcagcgtcccgaagtgctgggattacaggtgtgagccaccgcgcctggcctgggctgggaatctttgttgacttctttgggaacattatctctagagtctgcttttttgtgggccagtttgtagagatgtaacatgaagccattccagaaatggtaacttaaaaaaaaaaagactacatgtctaggaaactgttgagattcaaaggaatctcactgttcctaaataaatgtgtatagtgattatgaaaagt

SEQ ID NO: 437131 - DNA, 2918 bp, Homo sapiens
gggcgcgtgcgcgcgcacctcgctcacgcgccggcgcgctccttttgcaggctcgtggcggtcggtcagcggggcgttctcccacctgtagcgactcaggttactgaaaaggcgggaaaacgctgcgatggcggcagctgggggaggaggaagataagcgcgtgaggctggggtcctggcgcgtggttggcagaggcagagacataagacgtgcacgactcgccccacagggccctcagaccccttccttccaaaggagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaaga

SEQ ID NO: 437132 - DNA, 4368 bp, Homo sapiens
gggcgcgtgcgcgcgcacctcgctcacgcgccggcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaagatattgtttctttagtctcaaaacaagagactaggaaagatccaaaacacagagcaggagtccacaggggaacctgccctgcctcagtaaaaatacagtgttgttgctgtaggaagactcccggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaaggtgagtttattgttttcagtttagacttttgggaagttggactagagaggggagttgttggggtcagtgctggcttaacagaaaacacagcgaatttcccctccagttctccccaagtccactgaacaaggctagttcctgcaccacccaggattcaaaggaaagacgaagggagcagaacttgtggcagcaacaggtaaacttcaagaaggagggcaggagccccaccctacagggctgggaggagcccagaggccccatctgtttctcctccaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagcatgtttattgaaactgtccttcagccttaaatacaaaaataaaactgaaactgctccagaaagcagctttctccaaaaatgtctttggtttgtttctcatagggttaggaaaagtgcattgtgggaatatccattgccctctatcccagtcttgcagggtgttttgttttgttttgtttctgagatagggtctcactgtcgctcaggctgtagtgcagtggttcgaccacaactcactgcagcctcaacctcctgggctcaagtg

SEQ ID NO: 437133 - DNA, 4177 bp, Homo sapiens
gggcgcgtgcgcgcgcacctcgctcacgcgccggcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaagatattgtttctttagtctcaaaacaagagactaggaaagatccaaaacacagagcaggagtccacaggggaacctgccctgcctcagtaaaaatacagtgttgttgctgtaggaagactcccggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaaggtgagtttattgttttcagtttagacttttgggaagttggactagagaggggagttgttggggtcagtgctggcttaacagaaaacacagcgaatttcccctccagttctccccaagtccactgaacaaggctagttcctgcaccacccaggattcaaaggaaagacgaagggagcagaacttgtggcagcaacaggtaaacttcaagaaggagggcaggagccccaccctacagggctgggaggagcccagaggccccatctgtttctcctccaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagcatgtttattgaaactgtccttcagccttaaatacaaaaataaaactgaaactgctccagaaagcagctttctcc

SEQ ID NO: 437134 - DNA, 4262 bp, Homo sapiens
gggcgcgtgcgcgcgcacctcgctcacgcgccggcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaagatattgtttctttagtctcaaaacaagagactaggaaagatccaaaacacagagcaggagtccacaggggaacctgccctgcctcagtaaaaatacagtgttgttgctgtaggaagactcccggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaagttctccccaagtccactgaacaaggctagttcctgcaccacccaggattcaaaggaaagacgaagggagcagaacttgtggcagcaacaggtaaacttcaagaaggagggcaggagccccaccctacagggctgggaggagcccagaggccccatctgtttctcctccaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagcatgtttattgaaactgtccttcagccttaaatacaaaaataaaactgaaactgctccagaaagcagctttctccaaaaatgtctttggtttgtttctcatagggttaggaaaagtgcattgtgggaatatccattgccctctatcccagtcttgcagggtgttttgttttgttttgtttctgagatagggtctcactgtcgctcaggctgtagtgcagtggttcgaccacaactcactgcagcctcaacctcctgggctcaagtg

SEQ ID NO: 437135 - DNA, 4285 bp, Homo sapiens
gggcgcgtgcgcgcgcacctcgctcacgcgccggcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacaggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaagatattgtttctttagtctcaaaacaagagactaggaaagatccaaaacacagagcaggagtccacaggggaacctgccctgcctcagtaaaaatacagtgttgttgctgtaggaagactcccggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaaggtgagtttattgttttcagtttagacttttgggaagttggactagagaggggagttgttggggtcagtgctggcttaacagaaaacacagcgaatttcccctccagttctccccaagtccactgaacaaggctagttcctgcaccacccaggattcaaaggaaagacgaagggagcagaacttgtggcagcaacaggtaaacttcaagaaggagggcaggagccccaccctacagggctgggaggagcccagaggccccatctgtttctcctccaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagcatgtttattgaaactgtccttcagccttaaatacaaaaataaaactgaaactgctccagaaagcagctttctccaaaaatgtctttggtttgtttctcatagggttaggaaaagtgcattgtgggaatatccattgccctctatcccagtcttgcagggtgttttgttttgttttgtttctgagatagggtctcactgtcgctcaggctgtagtgcagtggttcgaccacaactcactgcagcctcaacctcctgggctcaagtg

SEQ ID NO: 437136 - DNA, 4395 bp, Homo sapiens
gggcgcgtgcgcgcgcacctcgctcacgcgccggcgcgctccttttgcaggctcgtggcggtcggtcagcggggcgttctcccacctgtagcgactcagggccctcagaccccttccttccaaaggagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaagatattgtttctttagtctcaaaacaagagactaggaaagatccaaaacacagagcaggagtccacaggggaacctgccctgcctcagtaaaaatacagtgttgttgctgtaggaagactcccggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaaggtgagtttattgttttcagtttagacttttgggaagttggactagagaggggagttgttggggtcagtgctggcttaacagaaaacacagcgaatttcccctccagttctccccaagtccactgaacaaggctagttcctgcaccacccaggattcaaaggaaagacgaagggagcagaacttgtggcagcaacaggtaaacttcaagaaggagggcaggagccccaccctacagggctgggaggagcccagaggccccatctgtttctcctccaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagcatgtttattgaaactgtccttcagccttaaatacaaaaataaaactgaaactgctccagaaagcagctttctccaaaaatgtctttggtttgtttctcatagggttaggaaaagtgcattgtgggaatatccattgccctctatcccagtcttgcagggtgttttgttttgttttgtttctgagatagggtctcactgtcgctcaggctgtagtgcagtggttcgaccacaactcactgcagcctcaacctcctgggctcaagtg

SEQ ID NO: 437137 - DNA, 4509 bp, Homo sapiens
gggcgcgtgcgcgcgcacctcgctcacgcgccggcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacaggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttggattggccaagggtttcaggacaggaaggaggtgattgatgatacactgtcttttattctcttttaagaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtgatgagatccaaatgtgcaaccacctccacatcagagctccctttcattcctagtcctactgggcctgggtctaggtccacaggatttctgacccttatttccccttctcttccccactccccttactcctcccaccttcttgcttgttcctaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaagatattgtttctttagtctcaaaacaagagactaggaaagatccaaaacacagagcaggagtccacaggggaacctgccctgcctcagtaaaaatacagtgttgttgctgtaggaagactcccggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaaggtgagtttattgttttcagtttagacttttgggaagttggactagagaggggagttgttggggtcagtgctggcttaacagaaaacacagcgaatttcccctccagttctccccaagtccactgaacaaggctagttcctgcaccacccaggattcaaaggaaagacgaagggagcagaacttgtggcagcaacaggtaaacttcaagaaggagggcaggagccccaccctacagggctgggaggagcccagaggccccatctgtttctcctccaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagcatgtttattgaaactgtccttcagccttaaatacaaaaataaaactgaaactgctccagaaagcagctttctccaaaaatgtctttggtttgtttctcatagggttaggaaaagtgcattgtgggaatatccattgccctctatcccagtcttgcagggtgttttgttttgttttgtttctgagatagggtctcactgtcgctcaggctgtagtgcagtggttcgaccacaactcactgcagcctcaacctcctgggctcaagtg

SEQ ID NO: 437138 - DNA, 3667 bp, Homo sapiens
gggcgcgtgcgcgcgcacctcgctcacgcgccggcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacaggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttggattggccaagggtttcaggacaggaaggaggtgattgatgatacactgtcttttattctcttttaagaccatggagacctgtgaggatggcaacgatcttgtcttcttctatcaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggaagactcccggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaagttctccccaagtccactgaacaaggctagttcctgcaccacccaggattcaaaggaaagacgaagggagcagaacttgtggcagcaacaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagcatgtttattgaaactgtccttcagccttaaatacaaaaataaaactgaaactgctccagaaagcagctttctcc

SEQ ID NO: 437139 - DNA, 2901 bp, Homo sapiens
gggcgcgtgcgcgcgcacctcgctcacgcgccggcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacaggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttggattggccaagggtttcaggacaggaaggaggtgattgatgatacactgtcttttattctcttttaagaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtgatgagatccaaatgtgcaaccacctccacatcagagctccctttcattcctagtcctactgggcctgggtctaggtccacaggatttctgacccttatttccccttctcttccccactccccttactcctcccaccttcttgcttgttcctaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaaga

SEQ ID NO: 437140 - DNA, 2629 bp, Homo sapiens
gggcgcgtgcgcgcgcacctcgctcacgcgccggcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacaggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaaga

SEQ ID NO: 437141 - DNA, 2510 bp, Homo sapiens
gggcgcgtgcgcgcgcacctcgctcacgcgccggcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacaggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttggattggccaagggtttcaggacaggaaggaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaaga

SEQ ID NO: 437142 - DNA, 416 bp, Homo sapiens
gccttcctccagcactttgcccttcagaaacccaccatttctttctgaaatccctaaatcttcaagatcccaggttttctgtgccacagcctctcccctctgcccagggatttggttgtccattctgccataaatcttgcgattttctctcttcttcagttgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 437143 - DNA, 2760 bp, Homo sapiens
gggcgcgtgcgcgcgcacctcgctcacgcgccggcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaaga

SEQ ID NO: 437144 - DNA, 4230 bp, Homo sapiens
gggcgcgtgcgcgcgcacctcgctcacgcgccggcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacacccccaggagatttaagatttaccccgattccactgctgatcccctccgttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaagatattgtttctttagtctcaaaacaagagactaggaaagatccaaaacacagagcaggagtccacaggggaacctgccctgcctcagtaaaaatacagtgttgttgctgtaggaagactcccggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaagttctccccaagtccactgaacaaggctagttcctgcaccacccaggattcaaaggaaagacgaagggagcagaacttgtggcagcaacaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagcatgtttattgaaactgtccttcagccttaaatacaaaaataaaactgaaactgctccagaaagcagctttctccaaaaatgtctttggtttgtttctcatagggttaggaaaagtgcattgtgggaatatccattgccctctatcccagtcttgcagggtgttttgttttgttttgtttctgagatagggtctcactgtcgctcaggctgtagtgcagtggttcgaccacaactcactgcagcctcaacctcctgggctcaagtg

SEQ ID NO: 437145 - DNA, 4092 bp, Homo sapiens
gggcgcgtgcgcgcgcacctcgctcacgcgccggcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaagatattgtttctttagtctcaaaacaagagactaggaaagatccaaaacacagagcaggagtccacaggggaacctgccctgcctcagtaaaaatacagtgttgttgctgtaggaagactcccggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagcatgtttattgaaactgtccttcagccttaaatacaaaaataaaactgaaactgctccagaaagcagctttctccaaaaatgtctttggtttgtttctcatagggttaggaaaagtgcattgtgggaatatccattgccctctatcccagtcttgcagggtgttttgttttgttttgtttctgagatagggtctcactgtcgctcaggctgtagtgcagtggttcgaccacaactcactgcagcctcaacctcctgggctcaagtg

SEQ ID NO: 437146 - DNA, 3991 bp, Homo sapiens
gggcgcgtgcgcgcgcacctcgctcacgcgccggcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaagatattgtttctttagtctcaaaacaagagactaggaaagatccaaaacacagagcaggagtccacaggggaacctgccctgcctcagtaaaaatacagtgttgttgctgtaggaagactcccggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaagttctccccaagtccactgaacaaggctagttcctgcaccacccaggattcaaaggaaagacgaagggagcagaacttgtggcagcaacaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagcatgtttattgaaactgtccttcagccttaaatacaaaaataaaactgaaactgctccagaaagcagctttctcc

SEQ ID NO: 437147 - DNA, 4532 bp, Homo sapiens
gggcgcgtgcgcgcgcacctcgctcacgcgccggcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacaggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatggtaagaccctcaacctctgtaaggtgagtgatgaggaaaatgagtcagcagctgaggaagagcgttactctacagcagcactgcccaatatgggatctctcctctgtagttttactctgagctttaccagcactgagacaaaggaaagagaagtcagagttaggggctggaggtggggttagaaagatggggaaggagaggaggaccaagagatgcaaagtccacagctttgaacccctgtacccagtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaagatattgtttctttagtctcaaaacaagagactaggaaagatccaaaacacagagcaggagtccacaggggaacctgccctgcctcagtaaaaatacagtgttgttgctgtaggaagactcccggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaaggtgagtttattgttttcagtttagacttttgggaagttggactagagaggggagttgttggggtcagtgctggcttaacagaaaacacagcgaatttcccctccagttctccccaagtccactgaacaaggctagttcctgcaccacccaggattcaaaggaaagacgaagggagcagaacttgtggcagcaacaggtaaacttcaagaaggagggcaggagccccaccctacagggctgggaggagcccagaggccccatctgtttctcctccaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagcatgtttattgaaactgtccttcagccttaaatacaaaaataaaactgaaactgctccagaaagcagctttctccaaaaatgtctttggtttgtttctcatagggttaggaaaagtgcattgtgggaatatccattgccctctatcccagtcttgcagggtgttttgttttgttttgtttctgagatagggtctcactgtcgctcaggctgtagtgcagtggttcgaccacaactcactgcagcctcaacctcctgggctcaagtg

SEQ ID NO: 437148 - DNA, 4268 bp, Homo sapiens
gggcgcgtgcgcgcgcacctcgctcacgcgccggcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacaggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttggattggccaagggtttcaggacaggaaggaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaagatattgtttctttagtctcaaaacaagagactaggaaagatccaaaacacagagcaggagtccacaggggaacctgccctgcctcagtaaaaatacagtgttgttgctgtaggaagactcccggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaaggtgagtttattgttttcagtttagacttttgggaagttggactagagaggggagttgttggggtcagtgctggcttaacagaaaacacagcgaatttcccctccagttctccccaagtccactgaacaaggctagttcctgcaccacccaggattcaaaggaaagacgaagggagcagaacttgtggcagcaacaggtaaacttcaagaaggagggcaggagccccaccctacagggctgggaggagcccagaggccccatctgtttctcctccaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagcatgtttattgaaactgtccttcagccttaaatacaaaaataaaactgaaactgctccagaaagcagctttctccaaaaatgtctttggtttgtttctcatagggttaggaaaagtgcattgtgggaatatccattgccctctatcccagtcttgcagggtgttttgttttgttttgtttctgagatagggtctcactgtcgctcaggctgtagtgcagtggttcgaccacaactcactgcagcctcaacctcctgggctcaagtg

SEQ ID NO: 437149 - DNA, 3573 bp, Homo sapiens
gctggcccagtgttcctagcgggctttaagaaatatatgttgactcatctggctgaactaagtatgatcaagacacttacagtgaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaagatattgtttctttagtctcaaaacaagagactaggaaagatccaaaacacagagcaggagtccacaggggaacctgccctgcctcagtaaaaatacagtgttgttgctgtaggaagactcccggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaaggtgagtttattgttttcagtttagacttttgggaagttggactagagaggggagttgttggggtcagtgctggcttaacagaaaacacagcgaatttcccctccagttctccccaagtccactgaacaaggctagttcctgcaccacccaggattcaaaggaaagacgaagggagcagaacttgtggcagcaacaggtaaacttcaagaaggagggcaggagccccaccctacagggctgggaggagcccagaggccccatctgtttctcctccaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagcatgtttattgaaactgtccttcagccttaaatacaaaaataaaactgaaactgctccagaaagcagctttctccaaaaatgtctttggtttgtttctcatagggttaggaaaagtgcattgtgggaatatccattgccctctatcccagtcttgcagggtgttttgttttgttttgtttctgagatagggtctcactgtcgctcaggctgtagtgcagtggttcgaccacaactcactgcagcctcaacctcctgggctcaagtg

SEQ ID NO: 437150 - DNA, 2660 bp, Homo sapiens
gggcgcgtgcgcgcgcacctcgctcacgcgccggcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacaggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttggattggccaagggtttcaggacaggaaggaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaaga

SEQ ID NO: 437151 - DNA, 2406 bp, Homo sapiens
ccctgttgaaatgtatcaatcccgtactttatctctccaggacaaggataagtgtggctacagtaaaagtttattgctctaaacggcgctaacctgagataatgagaaaaggccagaagagattgtttgatctctgtctgtcaatatatatgcatttcaactgtgaccatctggatccagggccctttctaacctatataacgactcatttgtttggttaatgatgaatatcactggggctcttaagtcctttcgttctatccaagacttcattgtttttttctgtatgaaaaaagtgcagaatatcactcacctttcccctacttttggatcccctacacgaggatcactagcttaatgagaagcagagtaacgctattaagtctgggcaagctccttataagttgctgtgtgcttaaaagaatgtgatttatgtctggggccaaagcagttttccttcttttccctcattgaattcaagacagctagacccttgtgtagatcccaggatattacctctactccccccaacctgtgtgtgtagggagagtaacaacacgggaagaggggagggaagttggaaggagattggtcacatgttcagttgtctgagatactggtaaatgtgcgctgtttgtcaatgaaggttgcatgcctgcatttacaaggtggtctcatactgattgtgctctgtccagttagattcgtggcttctcccttggaagctacaattaaggactagttagaagcagaggctagatgtgttctctccagcccttactaactgggaaaataattgagaaatccctcttttcctcagtgaaagcccagtcattggttagaaaaatctaattgtcaaactagcattatgttccatcatatctgtgggatagtaattcatgtaagacacatttttacctctcttacaagtcaattcacttacaagccagtttcaaatcaagcttcccttgcgaggaatggagatcattatggggcttattatgactacatttcttttatgagtgaccattttaaataattaatattttatttaatattaaattattaaagacttagctagacttttaacattagatgaaccttgtgaatcatatattgcatagattagcacatgtatgcaatctaggtcatcaatttgttgaatttatacagccctagatttgagattgtggccctgagtatctggatagttgagttgtgtgtttatgtgcttatatgatagaggtgctttgttcctgcagcttagaaacagaagcagccattcactgagaagcttaagagaggaagtatcaacctcattttccaaaccagcattactttcaccgctcgtggatctgaaagattacatttagaacatttagtactattacactctcagaaactgtggtaaaaagtcacattttcaaaacttcatgcatattgtattcttgttggaaataagtcctatagtttcttaattgtcttcatgccgtccatatttaacaaacattgcaagtcctttttatatttgggtaattatttgtaatttagtgaaggagactaggggatgttttcttccaaagggaatttaaaatcaattttatggtattttgaaagtaaaatactccttaacgtgtcaatatttttaaaatgttatctcgaagttttctattgctcaggtatataatctaataaaattttttgtttgctctaaggttatttttgctattctctattttgaattatgttaaaatttgtgtgcattttatgaaatgccttttttcttattttgaaagtgtaaaattgggcatctcagagtaaaatgtgggattattagctacaaagactaggcacatcgtgaaagctcagtaactaattttcttgactgagtcctatgccagagtgtcacagattcaacagaattttcctgaagggtgatacacaccaaaatctagcttgtgtggatctgagactattgactcaaagattcaaatctacttcggaagtgactccacggtttgagtgaaaactgaggaaggactcatgcctgtatatcactagatatcttatttctccataattttaagtgttcataatttcttcttctttgatgggtgtgcaactggggcatgtttgtaccagccagcatgtgttctgcccaacagtgtgtccgtgtgtgaggttaactgattcagaactcattctcttgataaactatttcttgaaagcatttattttaagtctttatttcctgctgaaatgaagtttcatgctgtcatgcccatcttatttattctagaagaaaattttcatagaagaaaatgatttatggccaaagttacagaacattcatcttttagacttagccttagaatatcattggaaattacttggcttgaatttggt

SEQ ID NO: 437152 - DNA, 1575 bp, Homo sapiens
gcggctggggagctgggagggttcagctgccacgtgagttatgcggccgctgctacacgcctggtgggcagcatgtcggcaacagcggctgctcgtaagcggggaaagccggcctctggggccggggctggcgcgggggccggcaagcggcggcgaaaggccgactctgcgggggacaggggcaaatccaagggtggcggcaagatgaatgaggagatctccagcgactctgagagcgagagcctagctccaaggaagcctgaggaggaggaggaggaggagctggaggaaactgcacaggaaaagaagctgcgcttggccaagctctacctagagcagctccgtcagcaagaggaggagaaggctgaggcccgtgcatttgaggaggaccaggtggcggggcgcctgaaggaggatgtgcttgagcagaggggcaggctgcagaagttggtggcaaaagagatccaggccccagcctcagctgacattcgcgttttacgggggcaccagctctctatcacatgtttggtcgtcacccccgatgactcagccatcttctctgctgccaaagactgcagcatcattaagtggagcgtggagagtggacggaagctgcatgtgattcctcgagccaagaagggtgccgagggaaagccccctggccacagcagccacgtcctctgcatggccatctcctccgacggcaagtaccttgcctctggtgaccgcagcaagctcattctcatttgggaggcccagagctgccagcacttgtacaccttcacaggacaccgggatgcagtgtcgggtctggcattccgcagaggcacccaccagctctacagcacatcccacgatcgctccgtgaaggtgtggaatgtggcagagaactcctacgtggagacgctcttcggacaccaggacgctgtggctgcactggatgccttgagccgggagtgctgtgtgacggctgggggccgggatgggactgtacgtgtgtggaagatccccgaggagtcccagcttgtcttctatggccaccagggctccatcgactgcatccacctaatcaatgaggagcacatggtgtccggcgcggacgatggctctgtggccttgtggggtctctccaagaagcgaccacttgccctgcagcgtgaagctcacgggctgcggggagagccaggcctggagcagcccttctggatatcgtcggtggcagccctcctcaacacagaccttgtggccacaggctcccacagctcctgtgtgcggctttggcagtgtggggaaggcttccggcagcttgaccttctctgtgacatccccctggtgggttttatcaacagcctcaagttctccagctctggggacttcctggtggctggggtagggcaggagcacaggcttggccgatggtggagaatcaaagaggctcggaattctgtctgcatcatcccactccgcagggtccctgtacccccagctgctggttcctgacactcttatcctccttatttaagtccttcccaggctatgccccaccctctttgtattaaaagcctcctcttttgg

SEQ ID NO: 437153 - DNA, 436 bp, Homo sapiens
ataaggcccagcccttgactgtgatgctgaggacggtggtggcggggggcgttctaatgtctttccgtgttgtctttctgctcaggtgggttttatcaacagcctcaagttctccagctctggggacttcctggtggctggggtagggcaggagcacaggtatgtgtggccctcgagggttcaggtaaggtggtgcaggctggacagctcggtggaaatggggtggagactgggccgagtctcagctgcgtcttgcactccctgcaggcttggccgatggtggagaatcaaagaggctcggaattctgtctgcatcatcccactccgcagggtccctgtacccccagctgctggttcctgacactcttatcctccttatttaagtccttcccaggctatgccccaccctctttgtattaaaagcctcctcttttgg

SEQ ID NO: 437154 - DNA, 1549 bp, Homo sapiens
gcggctggggagctgggagggttcagctgccacgtgagttatgcggccgctgctacacgcctggtgggcagcatgtcggcaacagcggctgctcgtaagcggggaaagccggcctctggggccggggctggcgcgggggccggcaagcggcggcgaaaggccgactctgcgggggacaggggcaaatccaagggtggcggcaagatgaatgaggagatctccagcgactctgagagcgagagcctagctccaaggaagcctgaggaggaggaggaggaggagctggaggaaactgcacaggaaaagaagctgcgcttggccaagctctacctagagcagctccgtcagcaagaggaggagaaggctgaggcccgtgcatttgaggaggaccaggtggcggggcgcctgaaggaggatgtgcttgagcagaggggcaggctgcagaagttggtggcaaaagagatccaggccccagcctcagctgacattcgcgttttacgggggcaccagctctctatcacatgtttggtcgtcacccccgatgactcagccatcttctctgctgccaaagactgcagcatcattaagtggagcgtggagagtggacggaagctgcatgtgattcctcgagccaagaagggtgccgagggaaagccccctggccacagcagccacgtcctctgcatggccatctcctccgacggcaagtaccttgcctctggtgaccgcagcaagctcattctcatttgggaggcccagagctgccagcacttgtacaccttcacaggacaccgggatgcagtgtcgggtctggcattccgcagaggcacccaccagctctacagcacatcccacgatcgctccgtgaaggtgtggaatgtggcagagaactcctacgtggagacgctcttcggacaccaggacgctgtggctgcactggatgccttgagccgggagtgctgtgtgacggctgggggccgggatgggactgtacgtgtgtggaagatccccgaggagtcccagcttgtcttctatggccaccagggctccatcgactgcatccacctaatcaatgaggagcacatggtgtccggcgcggacgatggctctgtggccttgtggggtctctccaagaagcgaccacttgccctgcagcgtgaagctcacgggctgcggggagagccaggcctggagcagcccttctggatatcgtcggtggcagccctcctcaacacagaccttgtggccacaggctcccacagctcctgtgtgcggctttggcagtgtggggaaggcttccggcagcttgaccttctctgtgacatccccctggtgggttttatcaacagcctcaagttctccagctctggggacttcctggtggctggggtagggcaggagcacaggcttggccgatggtggagaatcaaagaggctcggaattctgtctgcatcatcccactccgcagggtccctgtacccccagctgctggttcctgacactcttatcctcctctgtgccctcctctgtgctgtcgggacctctaga

SEQ ID NO: 437155 - DNA, 1288 bp, Homo sapiens
  misc_feature (1254)..(1254): n is a, c, g, or t
gcggctggggagctgggagggttcagctgccacgtgagttatgcggccgctgctacacgcctggtgggcagcatgtcggcaacagcggctgctcgtaagcggggaaagccggcctctggggccggggctggcgcgggggccggcaagcggcggcgaaaggccgactctgcgggggacaggggcaaatccaagggtggcggcaagatgaatgaggagatctccagcgactctgagagcgagagcctagctccaaggaagcctgaggaggaggaggaggaggagctggaggaaactgcacaggaaaagaagctgcgcttggccaagctctacctagagcagctccgtcagcaagaggaggagaaggctgaggcccgtgcatttgaggaggaccaggtggcggggcgcctgaaggaggatgtgcttgagcagaggggcaggctgcagaagttggtggcaaaagagatccaggccccagcctcagctgacattcgcgttttacgggggcaccagctctctatcacatgtttggtcgtcacccccgatgactcagccatcttctctgctgccaaagactgcagcatcattaagtggagcgtggagagtggacggaagctgcatgtgattcctcgagccaagaagggtgccgagggaaagccccctggccacagcagccacgtcctctgcatggccatctcctccgacggcaagtaccttgcctctggtgaccgcagcaagctcattctcatttgggaggcccagagctgccagcacttgtacaccttcacaggacaccgggatgcagtgtcgggtctggcattccgcagaggcacccaccagctctacagcacatcccacgatcgctccgtgaaggtgtggaatgtggcagagaactcctacgtggagacgctcttcggacaccaggacgctgtggctgcactggatgccttgagccgggagtgctgtgtgacggctgggggccgggatgggactgtacgtgtgtggaagatccccgaggagtcccagcttgtcttctatggccaccagggctccatcgactgcatccacctaatcaatgaggagcacatggtgtccggcgcggacgatggctctgtggccttgtggggtctctccaagaagcgaccacttgccctgcagcgtgaagctcacgggctgcggggagagccaggcctggagcagcccttctggatatcgtcggtggcagccctcctcaacacagaccttgtggccacaggntccccagttcctgggtcccgctcggccatgtggg

SEQ ID NO: 437156 - DNA, 1462 bp, Homo sapiens
gcggctggggagctgggagggttcagctgccacgtgagttatgcggccgctgctacacgcctggtgggcagcatgtcggcaacagcggctgctcgtaagcggggaaagccggcctctggggccggggctggcgcgggggccggcaagcggcggcgaaaggccgactctgcgggggacaggggcaaatccaagggtggcggcaagatgaatgaggagatctccagcgactctgagagcgagagcctagctccaaggaagcctgaggaggaggaggaggaggagctggaggaaactgcacaggaaaagaagctgcgcttggccaagctctacctagagcagctccgtcagcaagaggaggagaaggctgaggcccgtgcatttgaggaggaccaggtggcggggcgcctgaaggaggatgtgcttgagcagaggggcaggctgcagaagttggtggcaaaagagatccaggccccagcctcagctgacattcgcgttttacgggggcaccagctctctatcacatgtttggtcgtcacccccgatgactcagccatcttctctgctgccaaagactgcagcatcattaagtggagcgtggagagtggacggaagctgcatgtgattcctcgagccaagaagggtgccgagggaaagccccctggccacagcagccacgtcctctgcatggccatctcctccgacggcaagtaccttgcctctggtgaccgcagcaagctcattctcatttgggaggcccagagctgccagcacttgtacaccttcacaggacaccgggatgcagtgtcgggtctggcattccgcagaggcacccaccagctctacagcacatcccacgatcgctccgtgaaggtgtggaatgtggcagagaactcctacgtggagacgctcttcggacaccaggacgctgtggctgcactggatgccttgagccgggagtgctgtgtgacggctgggggccgggatgggactgtacgtgtgtggaagatccccgaggagtcccagcttgtcttctatggccaccagggctccatcgactgcatccacctaatcaatgaggagcacatggtgtccggcgcggacgatggctctgtggccttgtggggtctctccaagaagcgaccacttgccctgcagcgtgaagctcacgggctgcggggagagccaggcctggagcagcccttctggatatcgtcggtggcagccctcctcaacacagaccttgtggccacaggctcccacagctcctgtgtgcggctttggcagtgtggggaaggcttccggcagcttgaccttctctgtgacatccccctggtgggttttatcaacagcctcaagttctccagctctggggacttctggttcctgacactcttatcctccttatttaagtccttcccaggctatgccccaccctctttgtattaaaagcctcctcttttgg

SEQ ID NO: 437157 - DNA, 1393 bp, Homo sapiens
tcggtaccggcacgtggcgtggctcttcgcgcggctcttgtgtcttttctacatcccatagactcaggccgagaccccatgcgggcgcctggaggaggagctggaggaaactgcacaggaaaagaagctgcgcttggccaagctctacctagagcagctccgtcagcaagaggaggagaaggctgaggcccgtgcatttgaggaggaccaggtggcggggcgcctgaaggaggatgtgcttgagcagaggggcaggctgcagaagttggtggcaaaagagatccaggccccagcctcagctgacattcgcgttttacgggggcaccagctctctatcacatgtttggtcgtcacccccgatgactcagccatcttctctgctgccaaagactgcagcatcattaagtggagcgtggagagtggacggaagctgcatgtgattcctcgagccaagaagggtgccgagggaaagccccctggccacagcagccacgtcctctgcatggccatctcctccgacggcaagtaccttgcctctggtgaccgcagcaagctcattctcatttgggaggcccagagctgccagcacttgtacaccttcacaggacaccgggatgcagtgtcgggtctggcattccgcagaggcacccaccagctctacagcacatcccacgatcgctccgtgaaggtgtggaatgtggcagagaactcctacgtggagacgctcttcggacaccaggacgctgtggctgcactggatgccttgagccgggagtgctgtgtgacggctgggggccgggatgggactgtacgtgtgtggaagatccccgaggagtcccagcttgtcttctatggccaccagggctccatcgactgcatccacctaatcaatgaggagcacatggtgtccggcgcggacgatggctctgtggccttgtggggtctctccaagaagcgaccacttgccctgcagcgtgaagctcacgggctgcggggagagccaggcctggagcagcccttctggatatcgtcggtggcagccctcctcaacacagaccttgtggccacaggctcccacagctcctgtgtgcggctttggcagtgtggggaaggcttccggcagcttgaccttctctgtgacatccccctggtgggttttatcaacagcctcaagttctccagctctggggacttcctggtggctggggtagggcaggagcacaggcttggccgatggtggagaatcaaagaggctcggaattctgtctgcatcatcccactccgcagggtccctgtacccccagctgctggttcctgacactcttatcctccttatttaagtccttcccaggctatgccccaccctctttgtattaaaagcctcctcttttgg

SEQ ID NO: 437158 - DNA, 1927 bp, Homo sapiens
gcggctggggagctgggagggttcagctgccacgtgagttatgcggccgctgctacacgcctggtgggcagcatgtcggcaacagcggctgctcgtaagcggggaaagccggcctctggggccggggctggcgcgggggccggcaagcggcggcgaaaggccgactctgcgggggacaggggcaaatccaagggtggcggcaagatgaatgaggagatctccagcgactctgagagcgagagcctagctccaaggaagcctgaggaggaggaggaggaggagctggaggaaactgcacaggaaaagaagctgcgcttggccaagctctacctagagcagctccgtcagcaagaggaggagaaggctgaggcccgtgcatttgaggaggaccaggtggcggggcgcctgaaggaggatgtgcttgagcagaggggcaggctgcagaagttggtggcaaaagagatccaggccccagcctcagctgacattcgcgttttacgggggcaccagctctctatcacatgtttggtcgtcacccccgatgactcagccatcttctctgctgccaaagactgcagcatcattaagtggagcgtggagagtggacggaagctgcatgtgattcctcgagccaagaagggtgccgagggaaagccccctggccacagcagccacgtcctctgcatggccatctcctccgacggcaagtaccttgcctctggtgaccgcagcaagctcattctcatttgggaggcccagagctgccagcacttgtacaccttcacaggacaccgggatgcagtgtcgggtctggcattccgcagaggcacccaccagctctacagcacatcccacgatcgctccgtgaaggtgtggaatgtggcagagaactcctacgtggagacgctcttcggacaccaggacgctgtggctgcactggatgccttgagccgggagtgctgtgtgacggctgggggccgggatgggactgtacgtgtgtggaagatccccgaggagtcccagcttgtcttctatggccaccagggctccatcgactgcatccacctaatcaatgaggagcacatggtgtccggcgcggacgatggctctgtggccttgtggggtctctccaagaagcgaccacttgccctgcagcgtgaagctcacgggctgcggggagagccaggcctggagcagcccttctggatatcgtcggtggcagccctcctcaacacagaccttgtggccacaggctcccacagctcctgtgtgcggctttggcagtgtggggaaggcttccggcagcttgaccttctctgtgacatccccctggtgggttttatcaacagcctcaagttctccagctctggggacttcctggtggctggggtagggcaggagcacaggcttggccgatggtggagaatcaaagaggctcggaattctgtctgcatcatcccactccgcagggtccctgtacccccagctgctggttcctgacactcttatcctccttatttaagtccttcccaggctatgccccaccctctttgtattaaaagcctcctcttttggaaaaaaaaaaaaaaaaaaaaaaaaaaaaaaaaaaaaaaacccggggggctctttttgcggggggggggaaaacgggggtattatggaagtgggcccatggtgtgccaaatcgctgtggctctcctgtgcccccgtttttcttgtgtacacaacgggggagagaactcgcgcgcgcgggctccccctatataaggggaggcgcggataataaatttccgagataacgcccgggtgtacccccggcattaagggtctgcccgcgaaacacaccccccccgagaaccacaccccccccccagtcatcggccgcggcaacatctacagcgaccacagaagacatcttcactcaagc

SEQ ID NO: 437159 - DNA, 1683 bp, Homo sapiens
gcggctggggagctgggagggttcagctgccacgtgagttatgcggccgctgctacacgcctggtgggcagcatgtcggcaacagcggctgctcgtaagcggggaaagccggcctctggggccggggctggcgcgggggccggcaagcggcggcgaaaggccgactctgcgggggacaggggcaaatccaagggtggcggcaagatgaatgaggagatctccagcgactctgagagcgagagcctagctccaaggaagcctgaggaggaggaggaggaggagctggaggaaactgcacaggaaaagaagctgcgcttggccaagctctacctagagcagctccgtcagcaagaggaggagaaggctgaggcccgtgcatttgaggaggaccaggtggcggggcgcctgaaggaggatgtgcttgagcagaggggcaggctgcagaagttggtggcaaaagagatccaggccccagcctcagctgacattcgcgttttacgggggcaccagctctctatcacatgtttggtcgtcacccccgatgactcagccatcttctctgctgccaaagactgcagcatcattaagtggagcgtggagagtggacggaagctgcatgtgattcctcgagccaagaagggtgccgagggaaagccccctggccacagcagccacgtcctctgcatggccatctcctccgacggcaagtaccttgcctctggtgaccgcagcaagctcattctcatttgggaggcccagagctgccagcacttgtacaccttcacaggacaccgggatgcagtgtcgggtctggcattccgcagaggcacccaccagctctacagcacatcccacgatcgctccgtgaaggtgtggaatgtggcagagaactcctacgtggagacgctcttcggacaccaggacgctgtggctgcactggatgccttgagccgggagtgctgtgtgacggctgggggccgggatgggactgtacgtgtgtggaagatccccgaggagtcccagcttgtcttctatggccaccagggctccatcgactgcatccacctaatcaatgaggagcacatggtgtccggcgcggacgatggctctgtggccttgtggggtctctccaagaagcgaccacttgccctgcagcgtgaagctcacgggctgcggggagagccaggcctggagcagcccttctggatatcgtcggtggcagccctcctcaacacagaccttgtggccacaggctcccacagctcctgtgtgcggctttggcagtgtggggaaggcttccggcagcttgaccttctctgtgacatccccctggtgggttttatcaacagcctcaagttctccagctctggggacttcctggtggctggggtagggcaggagcacaggtatgtgtggccctcgagggttcaggtaaggtggtgcaggctggacagctcggtggaaatggggtggagactgggccgagtctcagctgcgtcttgcactccctgcaggcttggccgatggtggagaatcaaagaggctcggaattctgtctgcatcatcccactccgcagggtccctgtacccccagctgctggttcctgacactcttatcctccttatttaagtccttcccaggctatgccccaccctctttgtattaaaagcctcctcttttgg

SEQ ID NO: 437160 - DNA, 974 bp, Homo sapiens
  misc_feature (909)..(909): n is a, c, g, or t
gcggctggggagctgggagggttcagctgccacgtgagttatgcggccgctgctacacgcctggtgggcagcatgtcggcaacagcggctgctcgtaagcggggaaagccggcctctggggccggggctggcgcgggggccggcaagcggcggcgaaaggccgactctgcgggggacaggggcaaatccaagggtggcggcaagatgaatgaggagatctccagcgactctgagagcgagagcctagctccaaggaagcctgaggaggaggaggaggaggagctggaggaaactgcacaggaaaagaagctgcgcttggccaagctctacctagagcagctccgtcagcaagaggaggagaaggctgaggcccgtgcatttgaggaggaccaggtggcggggcgcctgaaggaggatgtgcttgagcagaggggcaggctgcagaagttggtggcaaaagagatccaggccccagcctcagctgacattcgcgttttacgggggcaccagctctctatcacatgtttggtcgtcacccccgatgactcagccatcttctctgctgccaaagactgcagcatcattaagtggagcgtggagagtggacggaagctgcatgtgattcctcgagccaagaagggtgccgagggaaagccccctggccacagcagccacgtcctctgcatggccatctcctccgacggcaagtaccttgcctctggtgaccgcagcaagctcattctcatttgggaggcccagagctgccagcacttgtacaccttcacaggacaccgggatgcagtgtcgggtctggcattccgcagaggcacccaccagctctacagcacatcccacgatcgctccgtgaaggtgtggaatgtggcagagaactcctacgtggagacgctntcggaaccggccggtgtggcgattctgaccgttgttaccgggccctgacggcgctgtaacccggc

SEQ ID NO: 437161 - DNA, 3292 bp, Homo sapiens
  misc_feature (1841)..(1841): n is a, c, g, or t
  misc_feature (1880)..(1880): n is a, c, g, or t
  misc_feature (2014)..(2014): n is a, c, g, or t
ggtttttgtgtagctgctttctctcacagtgtttgtaaacttgaacccaagtgcaccgttcacagtctccagctccagctcttcactaacacctttattccttgctgttggccttgggacccttactgttccccttgctgtgtagaaacagatgcagtcagacccacataagctggactttggactgaaacctgagttcctgagccgccctccaggccccagtctttttggagccatccaccacccccatgacctggcacggccttcaactttgttctctgccgctggtgagtgtgggtttgggtggggggacagagctgagaaatgtagttctcaggtaactaaataaatgaggtttgggctctgagctgccgctcagtcaccacctacaaaaatacagttaatgccagcttgcaaggcaacatcgcagcacatccagggagttgggaatcttcagtgatacactctctttcattaaaggaggaggcagagatcatctttcccttacagggattcacattgcttcggttcattatttgcttctatattaaaccagtataactcacaagcatgtcagttgctattgagaaagatctgaaggcttgcaagggcagatcggaaggaaacaatgccaggaattatagaaggatgcggtcgcccttaatacggtgcccgcagagcactgtaattttgcaccgggatgctcagtcatgccgtgttttaaagtcctgaggataaagaaaggcgattaaggcagttgccaggagtatggtctgtgatagggaggttgggccactcggttgctggttttctctgctacaaaacgtaatactattgcctggttggttatagcggtggaagaaatttaggaaacggtgtaaacacccaagtgacctgctcatcggatctgtaattcatttaacctctgagaatacacactgtcaagtgtgcgtgtggaaggggtgaggtagagagtgacgattatgctcattcctgctccaggtacaaacaaaagacagcggctgtaaggactgtgtgtgtgctggatgagaacagccctcttggtattaagggtttcttgtcattctgtcttctctaaagcttttttaagtgtaatttctggcacacagagctcagctcagttaacacttaaaaatgatggcactgagctcattctgctaataacttcatacccactatgctaagtagaatttattcttctggacgtaagcagtcaaggggctccccatttctgatccttacgagacaagtcttacagccatcctgccagctgccaccccaggcttttatccaagactcactgttggtggacctctggctcttctgttcaggaagagagaagcacccacactgcaagaaatcatcattataatgggccttagctaccaaagcaagtgcgtccccctggagggtagatggaatttgctaaggtctcaggtttttctctgtcagtgctgtctggggacatatttgaaggctctgttaccatggcacctaggctctgagacagggctacatgaagagcaatttttggaaagaatagatttctctctggcttccatttgagccaagtggatgaattggcttcttttgcttcaataattctggaactgcaaggcacccctgggggccctgggctcagcaaagctctggtcttcattgaagcattaattagcttgcactacacagacagtatgtggccaaaattttatttagctgacaacactgctaacggcctgatgaatattctggaatatattcacttggtggaggcggggtatcatttttacacttcccaggtggaaaataagccagtatgnagggctgaatagataactcctcaggtgtcttccaattcngaactactgtgacggggatgatgttcctcctgtactgagtggcttcctctccaaacccaggccacaagacttttgcagcccagggaacagcagtccaaaacataaatcgagttaacagagtgtagacagcaacnacccctacgtttaatccattttcctaagggaatttatatttgtttataggaacttagacaaaatgcaaaggattatggaacagtttttagtaaattctttatccaggccttgtttatacttccattctagaatgtaaccttctttagcataagcagtatgggattctgcccaaaatagttatttggtgaaccttgtaactgatgtgtataacttgtacatacttaagaaatccagccattttcatcttgctattgggtgctaatcccatgaatataaactagagacttcttcagatgaccctggcaaatctctcgtctaggacaaagcctgccttccaggaagctagcctccttagctagtaagtagcctcgtattaacaagcccatttggtgccctaaggcctttagaaatgtccttccctaattcacatttgcacactctctttctctgtctccttccttccttcctttcctggcttccttcaggaacaggaatagaggcatcttcaagaagtacacattaggcaaaatacagagaagaggaggaaatgtggatcaagggacaactgaaggaaaccactaaattagacctgagttccctggcaggcaaagcaaaaacctgtcagagtcagttataagattttcagtgccccaaaacataagaatcaaccagcttttcctggcattgaaagttgagagacatcagaggacttcatctcctaaaacctaattgagctcacaataatgagttttatagagtcgggccttatagtatccttcgatgtgggtgcatgcgaactaacatactcttcaggagaagggattctgcaagtccccagagcagcgtagccaagaaccacagcttcaggaccacccctcctgagccagggatgataacgggctgggtttctggaagtgtttctcaaagtgaaaacttggtcctccgagatgctctatgaggagtggattccatgacgaaatgttcccctcttagagaacgaaggagcctataagcttattaataagcttattaatggctctaagaagcccttcagtaaagaaacttgcttagctttttttaatccagtatttctccaaatttacttggttataaagcctcccctcctcccatgacccagggcagttatctctgtctttgtaatactgtgtgtcatcggcttaaaaaagaaatacctgtttttggtggtggccagccacgctgggaaagagaaagagggatgattgattttctgcttcctaaaaaaaaaaaaaaaaaaa

SEQ ID NO: 437162 - DNA, 520 bp, Homo sapiens
  misc_feature (1)..(1): n is a, c, g, or t
  misc_feature (3)..(3): n is a, c, g, or t
  misc_feature (41)..(41): n is a, c, g, or t
  misc_feature (86)..(86): n is a, c, g, or t
nanacctctccccagataccagttagtagacagctttaaangccagggtctgaaggccattctccctcagacctacccggtgtggnttggagctcaaaacagtgaaactcctggtgtgtgatgtgagcaaatcatgttgccagagggcacattgctattgattaaacttgtacaggggcttgtcagcgtagatgtaccaaggcttgtgaagtgggggaggggacacttggcacttttgatagtgtgaaaatgggttaattattctctaaaagggcttcatttaaaagtaaaattctaacattttaatttcccctcctaatgaagcactacaaatttgttaattagagcaattgtttgagtgacaggcatgtaaccaagttgtcattttctcttcacagttgacagatcctttcagacctatgttaaggaaaccagggaagtggtgtgctatgcatgttcacatcgcctggcagatttaccaccaccaacagaaagtcaaggtcagtccgaccttcgtggt

SEQ ID NO: 437163 - DNA, 4350 bp, Homo sapiens
  misc_feature (1)..(1): n is a, c, g, or t
  misc_feature (3)..(3): n is a, c, g, or t
  misc_feature (41)..(41): n is a, c, g, or t
  misc_feature (86)..(86): n is a, c, g, or t
nanacctctccccagataccagttagtagacagctttaaangccagggtctgaaggccattctccctcagacctacccggtgtggnttggagctcaaaacagtgaaactcctggtgtgtgatgtgagcaaatcatgttgccagagggcacattgctattgattaaacttgtacaggggcttgtcagcgtagatgtaccaaggcttgtgaagtgggggaggggacacttggcacttttgatagtgtgaaaatgggttaattattctctaaaagggcttcatttaaaagtaaaattctaacattttaatttcccctcctaatgaagcactacaaatttgttaattagagcaattgtttgagtgacaggcatgtaaccaagttgtcattttctcttcacagttgacagatcctttcagacctatgttaaggaaaccagggaagtggtgtgctatgcatgttcacatcgcctggcagatttaccaccaccaacagaaagtcaagaaacagatgcagtcagacccacataagctggactttggactgaaacctgagttcctgagccgccctccaggccccagtctttttggagccatccaccacccccatgacctggcacggccttcaactttgttctctgccgctggtgctgcacacccaactgggaccccttttgggccacctcctcatcacagcaacttcctcaaccctgctgcccacctagagccttttaatcggccgtctacattcacaggcctagcagcagttggtggcaatgccttcgggggacttggaaatccttccgttacacccaactcaatgttcggccacaaggatggccccagtgtgcagaactttagcaaccctcacgaaccctggaaccggctgcaccgaacgcctccgtcgttcccgacccctccgccctggctgaagccaggggagctggagcgcagcgcgtccgctgcagctcatgacagagatagagatgtagataaacgagactcatctgttagtaaagatgacaaagaaagggaaagcgtcgagaagagacactccagccacccttcaccagcacctgtcctcccggtgaatgccctgggacatacccgcagctccactgaacagatccgggctcatctgaacactgaggctcgggagaaggacaaacccaaagagagggagagagaccactcggaatcccgcaaggacctggccgccgacgagcacaaggcgaaagagggccacctgcccgagaaggacgggcacggccacgaggggcgcgccgcgggcgaagaggccaagcagctggcccgggtgccgtctccctacgtgcggaccccggtggtggagagtgccaggcccaacagcacctcgagccgggaggccgagccgcgcaagggtgagccggcctacgagaaccccaagaagagctccgaggtcaaggtgaaggaggagcggaaggaagaccatgacctgcctccagaggccccgcagacccaccgggcctcggagccgccgcctcccaactcctcgtccagcgtgcacccggggcccctggcctcgatgcccatgacggtgggggtgacgggcattcaccccatgaacagcatcagcagcctggacaggactcgcatgatgacccccttcatgggcatcagccccctcccgggcggagagcgcttcccgtacccttctttccactgggaccccatccgggaccccttgagggatccttaccgagaacttgacattcaccggagagacccgctgggcagggacttcctgctaaggaacgacccgctccaccggctctcgactccccggctgtacgaagccgaccgctccttcagggaccgggagcctcacgactacagccaccaccaccaccaccaccaccacccgctgtctgtggaccctcggcgggagcacgagcggggaggccacctggacgagcgggagcgcttgcacatgctcagagaagactacgagcacacgcggctccactccgtgcaccccgcctccctcgacggacacctcccccaccccagcctcatcaccccgggactccccagcatgcactatccccgcatcagccccaccgcgggcaaccagaacggactcctcaacaagacccctccgacagcagcgctgagcgcacctcccccgctcatctccacgctggggggccgcccggtctctcccagaaggacgactcctctgtccgcagagataagggagaggcccccttcccacacgctgaaggatatcgaggcccgataagccgagaacaggagcaagaacgaggaagaagaaaccctaggcagacaccaggccaggcttgagagacagaactcctgcatggctcacacagactgggggggaaagccccaccccttccccttgtaaaaaatgtatagactcagtgcacattttgaaatgttttgtatattatatgttgagatttttcagatcttttagcccagtcatatgttctcacgtctcctactttttgtttctcgtataaaactttttgatttgaaccaaaacagtgaagatgacaacacacaccaattggatgataattgtagcgggggcggtgggggggagaagtccacgccatccatcatgcaaaattctttcagatgaggtgggaaggccgtgtacatagttatgtaaaaagagattgcttcatgagctaatggttcatatatgcaaaagggtaagatgaaagctttactttgtacaaatgtaaatagataaagtaacataatacattaatacttcttaaaatgtgctatttgcaaacttacttaatatcagtgaacacagtcggctaaagctgtgttcccatatattgttatagacagctaaacccttcaactatgcaatgaatgttcgggcttttcacaaaagcccgcctaactcaaaggagccttttcaaatccatttacagcatacttaaggtcatattttccctgaacaagcgcttacgtgatatgactctgttttccttgcttgttttttttcaaacggagaaacatcctgttttgcaaattggaccccaggctggaacttagcatctgaagttgccgcttgtgggctctgggggaaagtgtagccccggagaggtaactgaggacatgagcaaccagtgccagggagggtgggatttgccagatgccaaaatcaggggacgggtggtggtgtctgtcagacacacacaggtcgccagtgacttcacacacacctcatgtgagaaccatgccttttttagtgtgtcctatttcatacctgtacacacttcctcgttttgtaatgagatttacttacacccaaacagatcctgaaagaaagcttcaagttttctcagatgatggatatgttttcactgtattcaataactgacggatgtaaggtgcacgtttcctgatgtgacgcactgtattccagctggtgatcaagtctgggaacagccgtaacaggtcaaccttgtggagccatcgcgagttagagggtgaaagatggcagaaaaaaaagtcttgtgtgtgagtgtgttttttgagtttgcatcaatcttaatgtctcttcataatacttttataatacattaagcctcttgtctacatatttggagagaatatgactttactagcagagaaatacaatatatcttgtctactggactgtaaaatatatgtatgaaataaaattagttccatttggtcttctagtatattaaagtgctatctgacgttgttatcctgtttttgcaaaaaaaaaaaaaaaaaaaaagttaactacagaccattgtttctaataagcagagagatctattttagtagtaaactgaaggtttagttgtgagcttcagattttgtgaactccagatgttgtgcggtgtttttttttttttttaagacaacaactaaaaaaatgcaaggaatatgtacactggaactgtagtggtagctttcagtattgtaaagagattgttctatacggacctttttgctgtttatcctgtatgtaataaagtcctttctagatcctatgtgaaaagaaaagtgaagcaactgaatcttcagcatgttctcatcggcggagccttcttgtgtaatgtaaactgtgccatgttattaaaaaatgtgaactaagcttccagctgcttgtttgtgtgaggtgaccatcattaccttagggaagaagccatacctgtacaagaccgggctcttgaaaagaaacacctcgaacccagcccgtgtaagaacagaaggctcacctgcagtggctgaccaccctacccaactcggttagtgtctcaccaatttgttactataaacatttgcaccccaca

SEQ ID NO: 437164 - DNA, 3834 bp, Homo sapiens
gaattaggtcatctcagtacccatttggtcccttttcctttttaacttcccctgtccccacctttgcttttggttttaaaaagaaaaaaaaaagctgtgagctacctctccagtgtaggacaagacttcctctaatgaatttgttaatctcctttccttttccagctcccaataatatgtattcattttaactctgaatgctgttaaaagttttttggtaagtaccttcattacagcagattatataatttctcttaaacctttttgttctccacttcaccatttcagcacccaactcaatgttcggccacaaggatggccccagtgtgcagaactttagcaaccctcacgaaccctggaaccggctgcaccgaacgcctccgtcgttcccgacccctccgccctggctgaagccaggggagctggagcgcagcgcgtccgctgcagctcatgacagagatagagatgtagataaacgagactcatctgttagtaaagatgacaaagaaagggaaagcgtcgagaagagacactccagccacccttcaccagcacctgtcctcccggtgaatgccctgggacatacccgcagctccactgaacagatccgggctcatctgaacactgaggctcgggagaaggacaaacccaaagagagggagagagaccactcggaatcccgcaaggacctggccgccgacgagcacaaggcgaaagagggccacctgcccgagaaggacgggcacggccacgaggggcgcgccgcgggcgaagaggccaagcagctggcccgggtgccgtctccctacgtgcggaccccggtggtggagagtgccaggcccaacagcacctcgagccgggaggccgagccgcgcaagggtgagccggcctacgagaaccccaagaagagctccgaggtcaaggtgaaggaggagcggaaggaagaccatgacctgcctccagaggccccgcagacccaccgggcctcggagccgccgcctcccaactcctcgtccagcgtgcacccggggcccctggcctcgatgcccatgacggtgggggtgacgggcattcaccccatgaacagcatcagcagcctggacaggactcgcatgatgacccccttcatgggcatcagccccctcccgggcggagagcgcttcccgtacccttctttccactgggaccccatccgggaccccttgagggatccttaccgagaacttgacattcaccggagagacccgctgggcagggacttcctgctaaggaacgacccgctccaccggctctcgactccccggctgtacgaagccgaccgctccttcagggaccgggagcctcacgactacagccaccaccaccaccaccaccaccacccgctgtctgtggaccctcggcgggagcacgagcggggaggccacctggacgagcgggagcgcttgcacatgctcagagaagactacgagcacacgcggctccactccgtgcaccccgcctccctcgacggacacctcccccaccccagcctcatcaccccgggactccccagcatgcactatccccgcatcagccccaccgcgggcaaccagaacggactcctcaacaagacccctccgacagcagcgctgagcgcacctcccccgctcatctccacgctggggggccgcccggtctctcccagaaggacgactcctctgtccgcagagataagggagaggcccccttcccacacgctgaaggatatcgaggcccgataagccgagaacaggagcaagaacgaggaagaagaaaccctaggcagacaccaggccaggcttgagagacagaactcctgcatggctcacacagactgggggggaaagccccaccccttccccttgtaaaaaatgtatagactcagtgcacattttgaaatgttttgtatattatatgttgagatttttcagatcttttagcccagtcatatgttctcacgtctcctactttttgtttctcgtataaaactttttgatttgaaccaaaacagtgaagatgacaacacacaccaattggatgataattgtagcgggggcggtgggggggagaagtccacgccatccatcatgcaaaattctttcagatgaggtgggaaggccgtgtacatagttatgtaaaaagagattgcttcatgagctaatggttcatatatgcaaaagggtaagatgaaagctttactttgtacaaatgtaaatagataaagtaacataatacattaatacttcttaaaatgtgctatttgcaaacttacttaatatcagtgaacacagtcggctaaagctgtgttcccatatattgttatagacagctaaacccttcaactatgcaatgaatgttcgggcttttcacaaaagcccgcctaactcaaaggagccttttcaaatccatttacagcatacttaaggtcatattttccctgaacaagcgcttacgtgatatgactctgttttccttgcttgttttttttcaaacggagaaacatcctgttttgcaaattggaccccaggctggaacttagcatctgaagttgccgcttgtgggctctgggggaaagtgtagccccggagaggtaactgaggacatgagcaaccagtgccagggagggtgggatttgccagatgccaaaatcaggggacgggtggtggtgtctgtcagacacacacaggtcgccagtgacttcacacacacctcatgtgagaaccatgccttttttagtgtgtcctatttcatacctgtacacacttcctcgttttgtaatgagatttacttacacccaaacagatcctgaaagaaagcttcaagttttctcagatgatggatatgttttcactgtattcaataactgacggatgtaaggtgcacgtttcctgatgtgacgcactgtattccagctggtgatcaagtctgggaacagccgtaacaggtcaaccttgtggagccatcgcgagttagagggtgaaagatggcagaaaaaaaagtcttgtgtgtgagtgtgttttttgagtttgcatcaatcttaatgtctcttcataatacttttataatacattaagcctcttgtctacatatttggagagaatatgactttactagcagagaaatacaatatatcttgtctactggactgtaaaatatatgtatgaaataaaattagttccatttggtcttctagtatattaaagtgctatctgacgttgttatcctgtttttgcaaaaaaaaaaaaaaaaaaaaagttaactacagaccattgtttctaataagcagagagatctattttagtagtaaactgaaggtttagttgtgagcttcagattttgtgaactccagatgttgtgcggtgtttttttttttttttaagacaacaactaaaaaaatgcaaggaatatgtacactggaactgtagtggtagctttcagtattgtaaagagattgttctatacggacctttttgctgtttatcctgtatgtaataaagtcctttctagatcctatgtgaaaagaaaagtgaagcaactgaatcttcagcatgttctcatcggcggagccttcttgtgtaatgtaaactgtgccatgttattaaaaaatgtgaactaagcttccagctgcttgtttgtgtgaggtgaccatcattaccttagggaagaagccatacctgtacaagaccgggctcttgaaaagaaacacctcgaacccagcccgtgtaagaacagaaggctcacctgcagtggctgaccaccctacccaactcggttagtgtctcaccaatttgttactataaacatttgcaccccaca

SEQ ID NO: 437165 - DNA, 4296 bp, Homo sapiens
  misc_feature (1)..(1): n is a, c, g, or t
  misc_feature (3)..(3): n is a, c, g, or t
  misc_feature (41)..(41): n is a, c, g, or t
  misc_feature (86)..(86): n is a, c, g, or t
nanacctctccccagataccagttagtagacagctttaaangccagggtctgaaggccattctccctcagacctacccggtgtggnttggagctcaaaacagtgaaactcctggtgtgtgatgtgagcaaatcatgttgccagagggcacattgctattgattaaacttgtacaggggcttgtcagcgtagatgtaccaaggcttgtgaagtgggggaggggacacttggcacttttgatagtgtgaaaatgggttaattattctctaaaagggcttcatttaaaagtaaaattctaacattttaatttcccctcctaatgaagcactacaaatttgttaattagagcaattgtttgagtgacaggcatgtaaccaagttgtcattttctcttcacagttgacagatcctttcagacctatgttaaggaaaccagggaagtggtgtgctatgcatgttcacatcgcctggcagatttaccaccaccaacagaaagtcaagaaacagatgcagtcagacccacataagctggactttggactgaaacctgagttcctgagccgccctccaggccccagtctttttggagccatccaccacccccatgacctggcacggccttcaactttgttctctgccgctggtgctgcacacccaactgggaccccttttgggccacctcctcatcacagcaacttcctcaaccctgctgcccacctagagccttttaatcggccgtctacattcacaggcctagcagcagttggtggcaatgccttcgggggacttggaaatccttccgttacacccaactcaatgttcggccacaaggatggccccagtgtgcagaactttagcaaccctcacgaaccctggaaccggctgcaccgaacgcctccgtcgttcccgacccctccgccctggctgaagccaggggagctggagcgcagcgcgtccgctgcagctcatgacagagatagagatgtagataaacgagactcatctgttagtaaagatgacaaagaaagggaaagcgtcgagaagagacactccagccacccttcaccagcacctgtcctcccggtgaatgccctgggacatacccgcagctccactgaacagatccgggctcatctgaacactgaggctcgggagaaggacaaacccaaagagagggagagagaccactcggaatcccgcaaggacctggccgccgacgagcacaaggcgaaagagggccacctgcccgagaaggacgggcacggccacgaggggcgcgccgcgggcgaagaggccaagcagctggcccgggtgccgtctccctacgtgcggaccccggtggtggagagtgccaggcccaacagcacctcgagccgggaggccgagccgcgcaagggtgagccggcctacgagaaccccaagaagagctccgaggtcaaggtgaaggaggagcggaaggaagaccatgacctgcctccagaggccccgcagacccaccgggcctcggagccgccgcctcccaactcctcgtccagcgtgcacccggggcccctggcctcgatgcccatgacggtgggggtgacgggcattcaccccatgaacagcatcagcagcctggacaggactcgcatgatgacccccttcatgggcatcagccccctcccgggcggagagcgcttcccgtacccttctttccactgggaccccatccgggaccccttgagggatccttaccgagaacttgacattcaccggagagacccgctgggcagggacttcctgctaaggaacgacccgctccaccggctctcgactccccggctgtacgaagccgaccgctccttcagggaccgggagcctcacgactacagccaccaccaccaccaccaccaccacccgctgtctgtggaccctcggcgggagcacgagcggggaggccacctggacgagcgggagcgcttgcacatgctcagagaagactacgagcacacgcggctccactccgtgcaccccgcctccctcgacggacacctcccccaccccagcctcatcaccccgggactccccagcatgcactatccccgcatcagccccaccgcgggcaaccagaacggactcctcaacaagacccctccgacagcagcgctgagcgcacctcccccgctcatctccacgctggggggccgcccggtctctcccagaaggacgactcctctgtccgcagagataagggagaggcccccttcccacacgctgaaggatatcgaggcccgataagccgagaacaggagcaagaacgaggaagaagaaaccctaggcagacaccaggccaggcttgagagacagaactcctgcatggctcacacagactgggggggaaagccccaccccttccccttgtaaaaaatgtatagactcagtgcacattttgaaatgttttgtatattatatgttgagatttttcagatcttttagcccagtcatatgttctcacgtctcctactttttgtttctcgtataaaactttttgatttgaaccaaaacagtgaagatgacaacacacaccaattggatgataattgtagcgggggcggtgggggggagaagtccacgccatccatcatgcaaaattctttcagatgaggtgggaaggccgtgtacatagttatgtaaaaagagattgcttcatgagctaatggttcatatatgcaaaagggtaagatgaaagctttactttgtacaaatgtaaatagataaagtaacataatacattaatacttcttaaaatgtgctatttgcaaacttacttaatatcagtgaacacagtcggctaaagctgtgttcccatatattgttatagacagctaaacccttcaactatgcaatgaatgttcgggcttttcacagtcatattttccctgaacaagcgcttacgtgatatgactctgttttccttgcttgttttttttcaaacggagaaacatcctgttttgcaaattggaccccaggctggaacttagcatctgaagttgccgcttgtgggctctgggggaaagtgtagccccggagaggtaactgaggacatgagcaaccagtgccagggagggtgggatttgccagatgccaaaatcaggggacgggtggtggtgtctgtcagacacacacaggtcgccagtgacttcacacacacctcatgtgagaaccatgccttttttagtgtgtcctatttcatacctgtacacacttcctcgttttgtaatgagatttacttacacccaaacagatcctgaaagaaagcttcaagttttctcagatgatggatatgttttcactgtattcaataactgacggatgtaaggtgcacgtttcctgatgtgacgcactgtattccagctggtgatcaagtctgggaacagccgtaacaggtcaaccttgtggagccatcgcgagttagagggtgaaagatggcagaaaaaaaagtcttgtgtgtgagtgtgttttttgagtttgcatcaatcttaatgtctcttcataatacttttataatacattaagcctcttgtctacatatttggagagaatatgactttactagcagagaaatacaatatatcttgtctactggactgtaaaatatatgtatgaaataaaattagttccatttggtcttctagtatattaaagtgctatctgacgttgttatcctgtttttgcaaaaaaaaaaaaaaaaaaaaagttaactacagaccattgtttctaataagcagagagatctattttagtagtaaactgaaggtttagttgtgagcttcagattttgtgaactccagatgttgtgcggtgtttttttttttttttaagacaacaactaaaaaaatgcaaggaatatgtacactggaactgtagtggtagctttcagtattgtaaagagattgttctatacggacctttttgctgtttatcctgtatgtaataaagtcctttctagatcctatgtgaaaagaaaagtgaagcaactgaatcttcagcatgttctcatcggcggagccttcttgtgtaatgtaaactgtgccatgttattaaaaaatgtgaactaagcttccagctgcttgtttgtgtgaggtgaccatcattaccttagggaagaagccatacctgtacaagaccgggctcttgaaaagaaacacctcgaacccagcccgtgtaagaacagaaggctcacctgcagtggctgaccaccctacccaactcggttagtgtctcaccaatttgttactataaacatttgcaccccaca

SEQ ID NO: 437166 - DNA, 3767 bp, Homo sapiens
  misc_feature (1)..(1): n is a, c, g, or t
  misc_feature (3)..(3): n is a, c, g, or t
  misc_feature (41)..(41): n is a, c, g, or t
  misc_feature (86)..(86): n is a, c, g, or t
nanacctctccccagataccagttagtagacagctttaaangccagggtctgaaggccattctccctcagacctacccggtgtggnttggagctcaaaacagtgaaactcctggtgtgtgatgtgagcaaatcatgttgccagagggcacattgctattgattaaacttgtacaggggcttgtcagcgtagatgtaccaaggcttgtgaagtgggggaggggacacttggcacttttgatagtgtgaaaatgggttaattattctctaaaagggcttcatttaaaagtaaaattctaacattttaatttcccctcctaatgaagcactacaaatttgttaattagagcaattgtttgagtgacaggcatgtaaccaagttgtcattttctcttcacagttgacagatcctttcagacctatgttaaggaaaccagggaagtggtgtgctatgcatgttcacatcgcctggcagatttaccaccaccaacagaaagtcaagaaacagatgcagtcagacccacataagctggactttggactgaaacctgagttcctgagccgccctccaggccccagtctttttggagccatccaccacccccatgacctggcacggccttcaactttgttctctgccgctggtgctgcacacccaactgggaccccttttgggccacctcctcatcacagcaacttcctcaaccctgctgcccacctagagccttttaatcggccgtctacattcacaggcctagcagcagttggtggcaatgccttcgggggacttggaaatccttccgttacacccaactcaatgttcggccacaaggatggccccagtgtgcagaactttagcaaccctcacgaaccctggaaccggctgcaccgaacgcctccgtcgttcccgacccctccgccctggctgaagccaggggagctggagcgcagcgcgtccgctgcagctcatgacagagatagagatgtagataaacgagactcatctgttagtaaagatgacaaagaaagggaaagcgtcgagaagagacactccagccacccttcaccagcacctgtcctcccggtgaatgccctgggacatacccgcagctccactgaacagatccgggctcatctgaacactgaggctcgggagaaggacaaacccaaagagagggagagagaccactcggaatcccgcaaggacctggccgccgacgagcacaaggcgaaagagggccacctgcccgagaaggacgggcacggccacgaggggcgcgccgcgggcgaagaggccaagcagctggcccgggtgccgtctccctacgtgcggaccccggtggtggagagtgccaggcccaacagcacctcgagccgggaggccgagccgcgcaagggtgagccggcctacgagaaccccaagaagagctccgaggtcaaggtgaaggaggagcggaaggaagaccatgacctgcctccagaggccccgcagacccaccgggcctcggagccgccgcctcccaactcctcgtccagcgtgcacccggggcccctggcctcgatgcccatgacggtgggggtgacgggcattcaccccatgaacagcatcagcagcctggacaggactcgcatgatgacccccttcatgggcatcagccccctcccgggcggagagcgcttcccgtacccttctttccactgggaccccatccgggaccccttgagggatccttaccgagaacttgacattcaccggagagacccgctgggcagggacttcctgctaaggaacgacccgctccaccggctctcgactccccggctgtacgaagccgaccgctccttcagggaccgggagcctcacgactacagccaccaccaccaccaccaccaccacccgctgtctgtggaccctcggcgggagcacgagcggggaggccacctggacgagcgggagcgcttgcacatgctcagagaagactacgagcacacgcggctccactccgtgcaccccgcctccctcgacggacacctcccccaccccagcctcatcaccccgggactccccagcatgcactatccccgcatcagccccaccgcgggcaaccagaacggactcctcaacaagacccctccgacagcagcgctgagcgcacctcccccgctcatctccacgctggggggccgcccggtctctcccagaaggacgactcctctgtccgcagagataagggagaggcccccttcccacacgctgaaggatatcgaggcccgataagccgagaacaggagcaagaacgaggaagaagaaaccctaggcagacaccaggccaggcttgagagacagaactcctgcatggctcacacagactgggggggaaagccccaccccttccccttgtaaaaaatgtatagactcagtgcacattttgaaatgttttgtatattatatgttgagatttttcagatcttttagcccagtcatatgttctcacgtctcctactttttgtttctcgtataaaactttttgatttgaaccaaaacagtgaagatgacaacacacaccaattggatgataattgtagcgggggcggtgggggggagaagtccacgccatccatcatgcaaaattctttcagatgaggtgggaaggccgtgtacatagttatgtaaaaagagattgcttcatgagctaatggttcatatatgcaaaagggtaagatgaaagctttactttgtacaaatgtaaatagataaagtaacataatacattaatacttcttaaaatgtgctatttgcaaacttacttaatatcagtgaacacagtcggctaaagctgtgttcccatatattgttatagacagctaaacccttcaactatgcaatgaatgttcgggcttttcacaaaagcccgcctaactcaaaggagccttttcaaatccatttacagcatacttaaggtcatattttccctgaacaagcgcttacgtgatatgactctgttttccttgcttgttttttttcaaacggagaaacatcctgttttgcaaattggaccccaggctggaacttagcatctgaagttgccgcttgtgggctctgggggaaagtgtagccccggagaggtaactgaggacatgagcaaccagtgccagggagggtgggatttgccagatgccaaaatcaggggacgggtggtggtgtctgtcagacacacacaggtcgccagtgacttcacacacacctcatgtgagaaccatgccttttttagtgtgtcctatttcatacctgtacacacttcctcgttttgtaatgagatttacttacacccaaacagatcctgaaagaaagcttcaagttttctcagatgatggatatgttttcactgtattcaataactgacggatgtaaggtgcacgtttcctgatgtgacgcactgtattccagctggtgatcaagtctgggaacagccgtaacaggtcaaccttgtggagccatcgcgagttagagggtgaaagatggcagaaaaaaaagtcttgtgtgtgagtgtgttttttgagtttgcatcaatcttaatgtctcttcataatacttttataatacattaagcctcttgtctacatatttggagagaatatgactttactagcagagaaatacaatatatcttgtctactggactgtaaaatatatgtatgaaataaaattagttccatttggtcttctagtatattaaagtgctatctgacgttgttatcctgtttttgc

SEQ ID NO: 437167 - DNA, 4293 bp, Homo sapiens
  misc_feature (1)..(1): n is a, c, g, or t
  misc_feature (3)..(3): n is a, c, g, or t
  misc_feature (41)..(41): n is a, c, g, or t
  misc_feature (86)..(86): n is a, c, g, or t
nanacctctccccagataccagttagtagacagctttaaangccagggtctgaaggccattctccctcagacctacccggtgtggnttggagctcaaaacagtgaaactcctggtgtgtgatgtgagcaaatcatgttgccagagggcacattgctattgattaaacttgtacaggggcttgtcagcgtagatgtaccaaggcttgtgaagtgggggaggggacacttggcacttttgatagtgtgaaaatgggttaattattctctaaaagggcttcatttaaaagtaaaattctaacattttaatttcccctcctaatgaagcactacaaatttgttaattagagcaattgtttgagtgacaggcatgtaaccaagttgtcattttctcttcacagttgacagatcctttcagacctatgttaaggaaaccagggaagtggtgtgctatgcatgttcacatcgcctggcagatttaccaccaccaacagaaagtcaagaaacagatgcagtcagacccacataagctggactttggactgaaacctgagttcctgagccgccctccaggccccagtctttttggagccatccaccacccccatgacctggcacggccttcaactttgttctctgccgctggtgctgcacacccaactgggaccccttttgggccacctcctcatcacagcaacttcctcaaccctgctgcccacctagagccttttaatcggccgtctacattcacaggcctagcagcagttggtggcaatgccttcgggggacttggaaatccttccgttacacccaactcaatgttcggccacaaggatggccccagtgtgcagaactttagcaaccctcacgaaccctggaaccggctgcaccgaacgcctccgtcgttcccgacccctccgccctggctgaagccaggggagctggagcgcagcgcgtccgctgcagctcatgacagagatagagatgtagataaacgagactcatctgttagtaaagatgacaaagaaagggaaagcgtcgagaagagacactccagccacccttcaccagcacctgtcctcccggtgaatgccctgggacatacccgcagctccactgaacagatccgggctcatctgaacactgaggctcgggagaaggacaaacccaaagagagggagagagaccactcggaatcccgcaaggacctggccgccgacgagcacaaggcgaaagagggccacctgcccgagaaggacgggcacggccacgaggggcgcgccgcgggcgaagaggccaagcagctggcccgggtgccgtctccctacgtgcggaccccggtggtggagagtgccaggcccaacagcacctcgagccgggaggccgagccgcgcaagggtgagccggcctacgagaaccccaagaagagctccgaggtcaaggtgaaggaggagcggaaggaagaccatgacctgcctccagaggccccgcagacccaccgggcctcggagccgccgcctcccaactcctcgtccagcgtgcacccggggcccctggcctcgatgcccatgacggtgggggtgacgggcattcaccccatgaacagcatcagcagcctggacaggactcgcatgatgacccccttcatgggcatcagccccctcccgggcggagagcgcttcccgtacccttctttccactgggaccccatccgggaccccttgagggatccttaccgagaacttgacattcaccggagagacccgctgggcagggacttcctgctaaggaacgacccgctccaccggctctcgactccccggctgtacgaagccgaccgctccttcagggaccgggagcctcacgactacagccaccaccaccaccaccaccaccacccgctgtctgtggaccctcggcgggagcacgagcggggaggccacctggacgagcgggagcgcttgcacatgctcagagaagactacgagcacacgcggctccactccgtgcaccccgcctccctcgacggacacctcccccaccccagcctcatcaccccgggactccccagcatgcactatccccgcatcagccccaccgcgggcaaccagaacggactcctcaacaagacccctccgacagcagcgctgagcgcacctcccccgctcatctccacgctggggggccgcccggtctctcccagaaggacgactcctctgtccgcagagataagggagaggcccccttcccacacgctgaaggatatcgaggcccgataagccgagaacaggagcaagaacgaggaagaagaaaccctaggcagacaccaggccaggcttgagagacagaactcctgcatggctcacacagactgggggggaaagccccaccccttccccttgtaaaaaatgtatagactcagtgcacattttgaaatgttttgtatattatatgttgagatttttcagatcttttagcccagtcatatgttctcacgtctcctactttttgtttctcgtataaaactttttgatttgaaccaaaacagtgaagatgacaacacacaccaattggatgataattgtagcgggggcggtgggggggagaagtccacgccatccatcatgcaaaattctttcagatgaggtgggaaggccgtgtacatagttatgtaaaaagagattgcttcatgagctaatggttcatatatgcaaaagggtaagatgaaagctttactttgtacaaatgtaaatagataaagtaacataatacattaatacttcttaaaatgtgctatttgcaaacttacttaatatcagtgaacacagtcggctaaagctgtgttcccatatattgttatagacagctaaacccttcaactatgcaatgaatgttcgggcttttcacaaaagcccgcctaactcaaaggagccttttcaaatccatttacagcatacttaaggtcatattttccctgaacaagcgcttacgtgatatgactctgttttccttgcttgttttttttcaaacggagaaacatcctgttttgcaaattggaccccaggctggaacttagcatctgaagttgccgcttgtgggctctgggggaaagtgtagccccggagaggtaactgaggacatgagcaaccagtgccagggagggtgggatttgccagatgccaaacacacctcatgtgagaaccatgccttttttagtgtgtcctatttcatacctgtacacacttcctcgttttgtaatgagatttacttacacccaaacagatcctgaaagaaagcttcaagttttctcagatgatggatatgttttcactgtattcaataactgacggatgtaaggtgcacgtttcctgatgtgacgcactgtattccagctggtgatcaagtctgggaacagccgtaacaggtcaaccttgtggagccatcgcgagttagagggtgaaagatggcagaaaaaaaagtcttgtgtgtgagtgtgttttttgagtttgcatcaatcttaatgtctcttcataatacttttataatacattaagcctcttgtctacatatttggagagaatatgactttactagcagagaaatacaatatatcttgtctactggactgtaaaatatatgtatgaaataaaattagttccatttggtcttctagtatattaaagtgctatctgacgttgttatcctgtttttgcaaaaaaaaaaaaaaaaaaaaagttaactacagaccattgtttctaataagcagagagatctattttagtagtaaactgaaggtttagttgtgagcttcagattttgtgaactccagatgttgtgcggtgtttttttttttttttaagacaacaactaaaaaaatgcaaggaatatgtacactggaactgtagtggtagctttcagtattgtaaagagattgttctatacggacctttttgctgtttatcctgtatgtaataaagtcctttctagatcctatgtgaaaagaaaagtgaagcaactgaatcttcagcatgttctcatcggcggagccttcttgtgtaatgtaaactgtgccatgttattaaaaaatgtgaactaagcttccagctgcttgtttgtgtgaggtgaccatcattaccttagggaagaagccatacctgtacaagaccgggctcttgaaaagaaacacctcgaacccagcccgtgtaagaacagaaggctcacctgcagtggctgaccaccctacccaactcggttagtgtctcaccaatttgttactataaacatttgcaccccaca

SEQ ID NO: 437168 - DNA, 1728 bp, Homo sapiens
ctttgtacaaatgtaaatagataaagtaacataatacattaatacttcttaaaatgtattatgttactttatctatttacatttgtacaaagtaaagctttcatcttaccctttgtacaaatgtaaatagataaagtaacataatacattaatacttcttaaaatgtgctatttgcaaacttacttaatatcagtgaacacagtcggctaaagctgtgttcccatatattgttatagacagctaaacccttcaactatgcaatgaatgttcgggcttttcacaaaagcccgcctaactcaaaggagccttttcaaatccatttacagcatacttaaggtcatattttccctgaacaagcgcttacgtgatatgactctgttttccttgcttgttttttttcaaacggagaaacatcctgttttgcaaattggaccccaggctggaacttagcatctgaagttgccgcttgtgggctctgggggaaagtgtagccccggagaggtaactgaggacatgagcaaccagtgccagggagggtgggatttgccagatgccaaaatcaggggacgggtggtggtgtctgtcagacacacacaggtcgccagtgacttcacacacacctcatgtgagaaccatgccttttttagtgtgtcctatttcatacctgtacacacttcctcgttttgtaatgagatttacttacacccaaacagatcctgaaagaaagcttcaagttttctcagatgatggatatgttttcactgtattcaataactgacggatgtaaggtgcacgtttcctgatgtgacgcactgtattccagctggtgatcaagtctgggaacagccgtaacaggtcaaccttgtggagccatcgcgagttagagggtgaaagatggcagaaaaaaaagtcttgtgtgtgagtgtgttttttgagtttgcatcaatcttaatgtctcttcataatacttttataatacattaagcctcttgtctacatatttggagagaatatgactttactagcagagaaatacaatatatcttgtctactggactgtaaaatatatgtatgaaataaaattagttccatttggtcttctagtatattaaagtgctatctgacgttgttatcctgtttttgcaaaaaaaaaaaaaaaaaaaaagttaactacagaccattgtttctaataagcagagagatctattttagtagtaaactgaaggtttagttgtgagcttcagattttgtgaactccagatgttgtgcggtgtttttttttttttttaagacaacaactaaaaaaatgcaaggaatatgtacactggaactgtagtggtagctttcagtattgtaaagagattgttctatacggacctttttgctgtttatcctgtatgtaataaagtcctttctagatcctatgtgaaaagaaaagtgaagcaactgaatcttcagcatgttctcatcggcggagccttcttgtgtaatgtaaactgtgccatgttattaaaaaatgtgaactaagcttccagctgcttgtttgtgtgaggtgaccatcattaccttagggaagaagccatacctgtacaagaccgggctcttgaaaagaaacacctcgaacccagcccgtgtaagaacagaaggctcacctgcagtggctgaccaccctacccaactcggttagtgtctcaccaatttgttactataaacatttgcaccccaca

SEQ ID NO: 437169 - DNA, 207 bp, Homo sapiens
aaaaaaaaaaaacacacattttcttttaccctgtgtcttgcctgcaggggcctgggtggacttcagccatgacctcccttgaacatattttctcacggggcccttaagcaagtagaagccggttgcatcttcgaagttggctttttgtaaactctggtttcgttatgtttgacttaacaggtgctgcacacccaactgggacccctt

SEQ ID NO: 437170 - DNA, 417 bp, Homo sapiens
gcccttttggttcactacaaggagcatttcagccgaaggtaagaaacctcacagtgaaaacacacaggcatgtgtctaagtggcgtcccgggccaggcgtgcaggaagttctgcgtcctcttgcctgtgcagtgactcattaatcaggtcctaagtgaccactgggattagagtgagcctatttttcttttttttccaagtccatctagttttaaatggccgtgaaaatttacttttcaaactgtactacccagataatctcagttaagctaagatttcttgtgctcttcaaaatatacacaatatttatttttttactaccaatatcgtggacataacttctggtcaggaattctatgaaatatcagacacatgtgcgccaggttgttccgcaggtgtatgtaattagtaaagaca

SEQ ID NO: 437171 - DNA, 5594 bp, Homo sapiens
cattgatggatttgccatgaccagctttgtcacttttgaagcgctggagaaagatgtagcacttaagcctcaggaacgtgtggagaaacgccagacgcccctgaccaagaagaaacgagaagcacttaccaatggcttgtcctttcattcaaagaagagcagactcagccacccacaccactacagctcagatcgagaaaatgaccgcaatctctgccagcaccttgggaagagaaagaaaatgccgaaggcactcagacagctcaagccaggacagaacagctgcagggacagtgacagtgaaagtgccagtggagaatccaagggcttccaccggagcagctctcgggaaaggctcagtgatagttcagctccttccagcttgggaacaggctacttctgtgacagtgacagtgaccaggaagagaaggcatcagatgccagctctgaaaaactcttcaacactgttattgtaaacaaagatccggagttaggtgttggcacgctaccagaacatgacagccaggatgcagggccgattgtccccaagatatcgggtctagagagaagccaggagaagagccaggactgttgcaaagagccaatctttgagcctgtggtgcttaaagacccctgccctcaggtcgcacagccaataccccagccgcagacggagccccaactccgagctccttctccggaccctgacttggtgcagcgcacagaggccccacctcaacccccacctctgagtacacagccaccacagggccctcctgaggcccagctccagcctgccccgcagcctcaggtgcagaggccacccaggccacagtcccccacccagctgctccatcagaacctcccacctgtgcaggcccacccctctgctcagagcctctcccagccattgtcagcctacaacagcagtagcttaagcctcaacagtttaagcagcagcagaagcagcactccagcgaagactcagcccgccccacctcacatctcccaccacccctctgcctccccgttccccctctccctgcccaaccacagccccctgcacagcttcacacccaccctccagccccccgcacactcacatcaccccaatatgtttgcccctcccactgctctgcctcctccaccaccactgacatcaggaagtctgcaggtggccggacacccggccgggagcacttactcagagcaagacatcttgcgacaggaactgaacactcgttttttggcctctcagagtgctgaccgcggggcttccctgggccctccgccctacctgcggaccgagttccatcagcaccagcaccagcaccagcacacccaccagcacacgcaccagcacaccttcacgccgttcccccacgccatcccacccaccgccatcatgccgacgccagcacctcccatgtttgacaaataccctacaaaagttgacccattctaccggcacagtctcttccattcctatcctcctgcagtgtcgggcatcccccctatgatcccacccactggcccttttggttcactacaaggagcatttcagccgaagacatccaaccctatcgatgtcgctgctcggcctgggacagtcccacacactttactccaaaaggacccgaggttgacagatcctttcagacctatgttaaggaaaccagggaagtggtgtgctatgcatgttcacatcgcctggcagatttaccaccaccaacagaaagtcaagaaacagatgcagtcagacccacataagctggactttggactgaaacctgagttcctgagccgccctccaggccccagtctttttggagccatccaccacccccatgacctggcacggccttcaactttgttctctgccgctggtgctgcacacccaactgggaccccttttgggccacctcctcatcacagcaacttcctcaaccctgctgcccacctagagccttttaatcggccgtctacattcacaggcctagcagcagttggtggcaatgccttcgggggacttggaaatccttccgttacacccaactcaatgttcggccacaaggatggccccagtgtgcagaactttagcaaccctcacgaaccctggaaccggctgcaccgaacgcctccgtcgttcccgacccctccgccctggctgaagccaggggagctggagcgcagcgcgtccgctgcagctcatgacagagatagagatgtagataaacgagactcatctgttagtaaagatgacaaagaaagggaaagcgtcgagaagagacactccagccacccttcaccagcacctgtcctcccggtgaatgccctgggacatacccgcagctccactgaacagatccgggctcatctgaacactgaggctcgggagaaggacaaacccaaagagagggagagagaccactcggaatcccgcaaggacctggccgccgacgagcacaaggcgaaagagggccacctgcccgagaaggacgggcacggccacgaggggcgcgccgcgggcgaagaggccaagcagctggcccgggtgccgtctccctacgtgcggaccccggtggtggagagtgccaggcccaacagcacctcgagccgggaggccgagccgcgcaagggtgagccggcctacgagaaccccaagaagagctccgaggtcaaggtgaaggaggagcggaaggaagaccatgacctgcctccagaggccccgcagacccaccgggcctcggagccgccgcctcccaactcctcgtccagcgtgcacccggggcccctggcctcgatgcccatgacggtgggggtgacgggcattcaccccatgaacagcatcagcagcctggacaggactcgcatgatgacccccttcatgggcatcagccccctcccgggcggagagcgcttcccgtacccttctttccactgggaccccatccgggaccccttgagggatccttaccgagaacttgacattcaccggagagacccgctgggcagggacttcctgctaaggaacgacccgctccaccggctctcgactccccggctgtacgaagccgaccgctccttcagggaccgggagcctcacgactacagccaccaccaccaccaccaccaccacccgctgtctgtggaccctcggcgggagcacgagcggggaggccacctggacgagcgggagcgcttgcacatgctcagagaagactacgagcacacgcggctccactccgtgcaccccgcctccctcgacggacacctcccccaccccagcctcatcaccccgggactccccagcatgcactatccccgcatcagccccaccgcgggcaaccagaacggactcctcaacaagacccctccgacagcagcgctgagcgcacctcccccgctcatctccacgctggggggccgcccggtctctcccagaaggacgactcctctgtccgcagagataagggagaggcccccttcccacacgctgaaggatatcgaggcccgataagccgagaacaggagcaagaacgaggaagaagaaaccctaggcagacaccaggccaggcttgagagacagaactcctgcatggctcacacagactgggggggaaagccccaccccttccccttgtaaaaaatgtatagactcagtgcacattttgaaatgttttgtatattatatgttgagatttttcagatcttttagcccagtcatatgttctcacgtctcctactttttgtttctcgtataaaactttttgatttgaaccaaaacagtgaagatgacaacacacaccaattggatgataattgtagcgggggcggtgggggggagaagtccacgccatccatcatgcaaaattctttcagatgaggtgggaaggccgtgtacatagttatgtaaaaagagattgcttcatgagctaatggttcatatatgcaaaagggtaagatgaaagctttactttgtacaaatgtaaatagataaagtaacataatacattaatacttcttaaaatgtgctatttgcaaacttacttaatatcagtgaacacagtcggctaaagctgtgttcccatatattgttatagacagctaaacccttcaactatgcaatgaatgttcgggcttttcacaaaagcccgcctaactcaaaggagccttttcaaatccatttacagcatacttaaggtcatattttccctgaacaagcgcttacgtgatatgactctgttttccttgcttgttttttttcaaacggagaaacatcctgttttgcaaattggaccccaggctggaacttagcatctgaagttgccgcttgtgggctctgggggaaagtgtagccccggagaggtaactgaggacatgagcaaccagtgccagggagggtgggatttgccagatgccaaaatcaggggacgggtggtggtgtctgtcagacacacacaggtcgccagtgacttcacacacacctcatgtgagaaccatgccttttttagtgtgtcctatttcatacctgtacacacttcctcgttttgtaatgagatttacttacacccaaacagatcctgaaagaaagcttcaagttttctcagatgatggatatgttttcactgtattcaataactgacggatgtaaggtgcacgtttcctgatgtgacgcactgtattccagctggtgatcaagtctgggaacagccgtaacaggtcaaccttgtggagccatcgcgagttagagggtgaaagatggcagaaaaaaaagtcttgtgtgtgagtgtgttttttgagtttgcatcaatcttaatgtctcttcataatacttttataatacattaagcctcttgtctacatatttggagagaatatgactttactagcagagaaatacaatatatcttgtctactggactgtaaaatatatgtatgaaataaaattagttccatttggtcttctagtatattaaagtgctatctgacgttgttatcctgtttttgcaaaaaaaaaaaaaaaaaaaaagttaactacagaccattgtttctaataagcagagagatctattttagtagtaaactgaaggtttagttgtgagcttcagattttgtgaactccagatgttgtgcggtgtttttttttttttttaagacaacaactaaaaaaatgcaaggaatatgtacactggaactgtagtggtagctttcagtattgtaaagagattgttctatacggacctttttgctgtttatcctgtatgtaataaagtcctttctagatcctatgtgaaaagaaaagtgaagcaactgaatcttcagcatgttctcatcggcggagccttcttgtgtaatgtaaactgtgccatgttattaaaaaatgtgaactaagcttccagctgcttgtttgtgtgaggtgaccatcattaccttagggaagaagccatacctgtacaagaccgggctcttgaaaagaaacacctcgaacccagcccgtgtaagaacagaaggctcacctgcagtggctgaccaccctacccaactcggttagtgtctcaccaatttgttactataaacatttgcaccccaca

SEQ ID NO: 437172 - DNA, 5492 bp, Homo sapiens
cattgatggatttgccatgaccagctttgtcacttttgaagcgctggagaaagatgtagcacttaagcctcaggaacgtgtggagaaacgccagacgcccctgaccaagaagaaacgagaagcacttaccaatggcttgtcctttcattcaaagaagagcagactcagccacccacaccactacagctcagatcgagaaaatgaccgcaatctctgccagcaccttgggaagagaaagaaaatgccgaaggcactcagacagctcaagccaggacagaacagctgcagggacagtgacagtgaaagtgccagtggagaatccaagggcttccaccggagcagctctcgggaaaggctcagtgatagttcagctccttccagcttgggaacaggctacttctgtgacagtgacagtgaccaggaagagaaggcatcagatgccagctctgaaaaactcttcaacactgttattgtaaacaaagatccggagttaggtgttggcacgctaccagaacatgacagccaggatgcagggccgattgtccccaagatatcgggtctagagagaagccaggagaagagccaggactgttgcaaagagccaatctttgagcctgtggtgcttaaagacccctgccctcaggtcgcacagccaataccccagccgcagacggagccccaactccgagctccttctccggaccctgacttggtgcagcgcacagaggccccacctcaacccccacctctgagtacacagccaccacagggccctcctgaggcccagctccagcctgccccgcagcctcaggtgcagaggccacccaggccacagtcccccacccagctgctccatcagaacctcccacctgtgcaggcccacccctctgctcagagcctctcccagccattgtcagcctacaacagcagtagcttaagcctcaacagtttaagcagcagcagaagcagcactccagcgaagactcagcccgccccacctcacatctcccaccacccctctgcctccccgttccccctctccctgcccaaccacagccccctgcacagcttcacacccaccctccagccccccgcacactcacatcaccccaatatgtttgcccctcccactgctctgcctcctccaccaccactgacatcaggaagtctgcaggtggccggacacccggccgggagcacttactcagagcaagacatcttgcgacaggaactgaacactcgttttttggcctctcagagtgctgaccgcggggcttccctgggccctccgccctacctgcggaccgagttccatcagcaccagcaccagcaccagcacacccaccagcacacgcaccagcacaccttcacgccgttcccccacgccatcccacccaccgccatcatgccgacgccagcacctcccatgtttgacaaataccctacaaaagttgacccattctaccggcacagtctcttccattcctatcctcctgcagtgtcgggcatcccccctatgatcccacccactggcccttttggttcactacaaggagcatttcagccgaagaaaccagggaagtggtgtgctatgcatgttcacatcgcctggcagatttaccaccaccaacagaaagtcaagaaacagatgcagtcagacccacataagctggactttggactgaaacctgagttcctgagccgccctccaggccccagtctttttggagccatccaccacccccatgacctggcacggccttcaactttgttctctgccgctggtgctgcacacccaactgggaccccttttgggccacctcctcatcacagcaacttcctcaaccctgctgcccacctagagccttttaatcggccgtctacattcacaggcctagcagcagttggtggcaatgccttcgggggacttggaaatccttccgttacacccaactcaatgttcggccacaaggatggccccagtgtgcagaactttagcaaccctcacgaaccctggaaccggctgcaccgaacgcctccgtcgttcccgacccctccgccctggctgaagccaggggagctggagcgcagcgcgtccgctgcagctcatgacagagatagagatgtagataaacgagactcatctgttagtaaagatgacaaagaaagggaaagcgtcgagaagagacactccagccacccttcaccagcacctgtcctcccggtgaatgccctgggacatacccgcagctccactgaacagatccgggctcatctgaacactgaggctcgggagaaggacaaacccaaagagagggagagagaccactcggaatcccgcaaggacctggccgccgacgagcacaaggcgaaagagggccacctgcccgagaaggacgggcacggccacgaggggcgcgccgcgggcgaagaggccaagcagctggcccgggtgccgtctccctacgtgcggaccccggtggtggagagtgccaggcccaacagcacctcgagccgggaggccgagccgcgcaagggtgagccggcctacgagaaccccaagaagagctccgaggtcaaggtgaaggaggagcggaaggaagaccatgacctgcctccagaggccccgcagacccaccgggcctcggagccgccgcctcccaactcctcgtccagcgtgcacccggggcccctggcctcgatgcccatgacggtgggggtgacgggcattcaccccatgaacagcatcagcagcctggacaggactcgcatgatgacccccttcatgggcatcagccccctcccgggcggagagcgcttcccgtacccttctttccactgggaccccatccgggaccccttgagggatccttaccgagaacttgacattcaccggagagacccgctgggcagggacttcctgctaaggaacgacccgctccaccggctctcgactccccggctgtacgaagccgaccgctccttcagggaccgggagcctcacgactacagccaccaccaccaccaccaccaccacccgctgtctgtggaccctcggcgggagcacgagcggggaggccacctggacgagcgggagcgcttgcacatgctcagagaagactacgagcacacgcggctccactccgtgcaccccgcctccctcgacggacacctcccccaccccagcctcatcaccccgggactccccagcatgcactatccccgcatcagccccaccgcgggcaaccagaacggactcctcaacaagacccctccgacagcagcgctgagcgcacctcccccgctcatctccacgctggggggccgcccggtctctcccagaaggacgactcctctgtccgcagagataagggagaggcccccttcccacacgctgaaggatatcgaggcccgataagccgagaacaggagcaagaacgaggaagaagaaaccctaggcagacaccaggccaggcttgagagacagaactcctgcatggctcacacagactgggggggaaagccccaccccttccccttgtaaaaaatgtatagactcagtgcacattttgaaatgttttgtatattatatgttgagatttttcagatcttttagcccagtcatatgttctcacgtctcctactttttgtttctcgtataaaactttttgatttgaaccaaaacagtgaagatgacaacacacaccaattggatgataattgtagcgggggcggtgggggggagaagtccacgccatccatcatgcaaaattctttcagatgaggtgggaaggccgtgtacatagttatgtaaaaagagattgcttcatgagctaatggttcatatatgcaaaagggtaagatgaaagctttactttgtacaaatgtaaatagataaagtaacataatacattaatacttcttaaaatgtgctatttgcaaacttacttaatatcagtgaacacagtcggctaaagctgtgttcccatatattgttatagacagctaaacccttcaactatgcaatgaatgttcgggcttttcacaaaagcccgcctaactcaaaggagccttttcaaatccatttacagcatacttaaggtcatattttccctgaacaagcgcttacgtgatatgactctgttttccttgcttgttttttttcaaacggagaaacatcctgttttgcaaattggaccccaggctggaacttagcatctgaagttgccgcttgtgggctctgggggaaagtgtagccccggagaggtaactgaggacatgagcaaccagtgccagggagggtgggatttgccagatgccaaaatcaggggacgggtggtggtgtctgtcagacacacacaggtcgccagtgacttcacacacacctcatgtgagaaccatgccttttttagtgtgtcctatttcatacctgtacacacttcctcgttttgtaatgagatttacttacacccaaacagatcctgaaagaaagcttcaagttttctcagatgatggatatgttttcactgtattcaataactgacggatgtaaggtgcacgtttcctgatgtgacgcactgtattccagctggtgatcaagtctgggaacagccgtaacaggtcaaccttgtggagccatcgcgagttagagggtgaaagatggcagaaaaaaaagtcttgtgtgtgagtgtgttttttgagtttgcatcaatcttaatgtctcttcataatacttttataatacattaagcctcttgtctacatatttggagagaatatgactttactagcagagaaatacaatatatcttgtctactggactgtaaaatatatgtatgaaataaaattagttccatttggtcttctagtatattaaagtgctatctgacgttgttatcctgtttttgcaaaaaaaaaaaaaaaaaaaaagttaactacagaccattgtttctaataagcagagagatctattttagtagtaaactgaaggtttagttgtgagcttcagattttgtgaactccagatgttgtgcggtgtttttttttttttttaagacaacaactaaaaaaatgcaaggaatatgtacactggaactgtagtggtagctttcagtattgtaaagagattgttctatacggacctttttgctgtttatcctgtatgtaataaagtcctttctagatcctatgtgaaaagaaaagtgaagcaactgaatcttcagcatgttctcatcggcggagccttcttgtgtaatgtaaactgtgccatgttattaaaaaatgtgaactaagcttccagctgcttgtttgtgtgaggtgaccatcattaccttagggaagaagccatacctgtacaagaccgggctcttgaaaagaaacacctcgaacccagcccgtgtaagaacagaaggctcacctgcagtggctgaccaccctacccaactcggttagtgtctcaccaatttgttactataaacatttgcaccccaca

SEQ ID NO: 437173 - DNA, 4296 bp, Homo sapiens
  misc_feature (1)..(1): n is a, c, g, or t
  misc_feature (3)..(3): n is a, c, g, or t
  misc_feature (41)..(41): n is a, c, g, or t
  misc_feature (86)..(86): n is a, c, g, or t
nanacctctccccagataccagttagtagacagctttaaangccagggtctgaaggccattctccctcagacctacccggtgtggnttggagctcaaaacagtgaaactcctggtgtgtgatgtgagcaaatcatgttgccagagggcacattgctattgattaaacttgtacaggggcttgtcagcgtagatgtaccaaggcttgtgaagtgggggaggggacacttggcacttttgatagtgtgaaaatgggttaattattctctaaaagggcttcatttaaaagtaaaattctaacattttaatttcccctcctaatgaagcactacaaatttgttaattagagcaattgtttgagtgacaggcatgtaaccaagttgtcattttctcttcacagttgacagatcctttcagacctatgttaaggaaaccagggaagtggtgtgctatgcatgttcacatcgcctggcagatttaccaccaccaacagaaagtcaagaaacagatgcagtcagacccacataagctggactttggactgaaacctgagttcctgagccgccctccaggccccagtctttttggagccatccaccacccccatgacctggcacggccttcaactttgttctctgccgctggtgctgcacacccaactgggaccccttttgggccacctcctcatcacagcaacttcctcaaccctgctgcccacctagagccttttaatcggccgtctacattcacaggcctagcagcagttggtggcaatgccttcgggggacttggaaatccttccgttacacccaactcaatgttcggccacaaggatggccccagtgtgcagaactttagcaaccctcacgaaccctggaaccggctgcaccgaacgcctccgtcgttcccgacccctccgccctggctgaagccaggggagctggagcgcagcgcgtccgctgcagctcatgacagagatagagatgtagataaacgagactcatctgttagtaaagatgacaaagaaagggaaagcgtcgagaagagacactccagccacccttcaccagcacctgtcctcccggtgaatgccctgggacatacccgcagctccactgaacagatccgggctcatctgaacactgaggctcgggagaaggacaaacccaaagagagggagagagaccactcggaatcccgcaaggacctggccgccgacgagcacaaggcgaaagagggccacctgcccgagaaggacgggcacggccacgaggggcgcgccgcgggcgaagaggccaagcagctggcccgggtgccgtctccctacgtgcggaccccggtggtggagagtgccaggcccaacagcacctcgagccgggaggccgagccgcgcaagggtgagccggcctacgagaaccccaagaagagctccgaggtcaaggtgaaggaggagcggaaggaagaccatgacctgcctccagaggccccgcagacccaccgggcctcggagccgccgcctcccaactcctcgtccagcgtgcacccggggcccctggcctcgatgcccatgacggtgggggtgacgggcattcaccccatgaacagcatcagcagcctggacaggactcgcatgatgacccccttcatgggcatcagccccctcccgggcggagagcgcttcccgtacccttctttccactgggaccccatccgggaccccttgagggatccttaccgagaacttgacattcaccggagagacccgctgggcagggacttcctgctaaggaacgacccgctccaccggctctcgactccccggctgtacgaagccgaccgctccttcagggaccgggagcctcacgactacagccaccaccaccaccaccaccaccacccgctgtctgtggaccctcggcgggagcacgagcggggaggccacctggacgagcgggagcgcttgcacatgctcagagaagactacgagcacacgcggctccactccgtgcaccccgcctccctcgacggacacctcccccaccccagcctcatcaccccgggactccccagcatgcactatccccgcatcagccccaccgcgggcaaccagaacggactcctcaacaagacccctccgacagcagcgctgagcgcacctcccccgctcatctccacgctggggggccgcccggtctctcccagaaggacgactcctctgtccgcagagataagggagaggcccccttcccacacgctgaaggatatcgaggcccgataagccgagaacaggagcaagaacgaggaagaagaaaccctaggcagacaccaggccaggcttgagagacagaactcctgcatggctcacacagactgggggggaaagccccaccccttccccttgtaaaaaatgtatagactcagtgcacattttgaaatgttttgtatattatatgttgagatttttcagatcttttagcccagtcatatgttctcacgtctcctactttttgtttctcgtataaaactttttgatttgaaccaaaacagtgaagatgacaacacacaccaattggatgataattgtagcgggggcggtgggggggagaagtccacgccatccatcatgcaaaattctttcagatgaggtgggaaggccgtgtacatagttatgtaaaaagagattgcttcatgagctaatggttcatatatgcaaaagggtaagatgaaagctttactttgtacaaatgtaaatagataaagtaacataatacattaatacttctttgtgttcccatatattgttatagacagctaaacccttcaactatgcaatgaatgttcgggcttttcacaaaagcccgcctaactcaaaggagccttttcaaatccatttacagcatacttaaggtcatattttccctgaacaagcgcttacgtgatatgactctgttttccttgcttgttttttttcaaacggagaaacatcctgttttgcaaattggaccccaggctggaacttagcatctgaagttgccgcttgtgggctctgggggaaagtgtagccccggagaggtaactgaggacatgagcaaccagtgccagggagggtgggatttgccagatgccaaaatcaggggacgggtggtggtgtctgtcagacacacacaggtcgccagtgacttcacacacacctcatgtgagaaccatgccttttttagtgtgtcctatttcatacctgtacacacttcctcgttttgtaatgagatttacttacacccaaacagatcctgaaagaaagcttcaagttttctcagatgatggatatgttttcactgtattcaataactgacggatgtaaggtgcacgtttcctgatgtgacgcactgtattccagctggtgatcaagtctgggaacagccgtaacaggtcaaccttgtggagccatcgcgagttagagggtgaaagatggcagaaaaaaaagtcttgtgtgtgagtgtgttttttgagtttgcatcaatcttaatgtctcttcataatacttttataatacattaagcctcttgtctacatatttggagagaatatgactttactagcagagaaatacaatatatcttgtctactggactgtaaaatatatgtatgaaataaaattagttccatttggtcttctagtatattaaagtgctatctgacgttgttatcctgtttttgcaaaaaaaaaaaaaaaaaaaaagttaactacagaccattgtttctaataagcagagagatctattttagtagtaaactgaaggtttagttgtgagcttcagattttgtgaactccagatgttgtgcggtgtttttttttttttttaagacaacaactaaaaaaatgcaaggaatatgtacactggaactgtagtggtagctttcagtattgtaaagagattgttctatacggacctttttgctgtttatcctgtatgtaataaagtcctttctagatcctatgtgaaaagaaaagtgaagcaactgaatcttcagcatgttctcatcggcggagccttcttgtgtaatgtaaactgtgccatgttattaaaaaatgtgaactaagcttccagctgcttgtttgtgtgaggtgaccatcattaccttagggaagaagccatacctgtacaagaccgggctcttgaaaagaaacacctcgaacccagcccgtgtaagaacagaaggctcacctgcagtggctgaccaccctacccaactcggttagtgtctcaccaatttgttactataaacatttgcaccccaca

SEQ ID NO: 437174 - DNA, 3730 bp, Homo sapiens
  misc_feature (1)..(1): n is a, c, g, or t
  misc_feature (3)..(3): n is a, c, g, or t
  misc_feature (41)..(41): n is a, c, g, or t
  misc_feature (86)..(86): n is a, c, g, or t
nanacctctccccagataccagttagtagacagctttaaangccagggtctgaaggccattctccctcagacctacccggtgtggnttggagctcaaaacagtgaaactcctggtgtgtgatgtgagcaaatcatgttgccagagggcacattgctattgattaaacttgtacaggggcttgtcagcgtagatgtaccaaggcttgtgaagtgggggaggggacacttggcacttttgatagtgtgaaaatgggttaattattctctaaaagggcttcatttaaaagtaaaattctaacattttaatttcccctcctaatgaagcactacaaatttgttaattagagcaattgtttgagtgacaggcatgtaaccaagttgtcattttctcttcacagttgacagatcctttcagacctatgttaaggaaaccagggaagtggtgtgctatgcatgttcacatcgcctggcagatttaccaccaccaacagaaagtcaagaaacagatgcagtcagacccacataagctggactttggactgaaacctgagttcctgagccgccctccaggccccagtctttttggagccatccaccacccccatgacctggcacggccttcaactttgttctctgccgctggtgctgcacacccaactgggaccccttttgggccacctcctcatcacagcaacttcctcaaccctgctgcccacctagagccttttaatcggccgtctacattcacaggcctagcagcagttggtggcaatgccttcgggggacttggaaatccttccgttacacccaactcaatgttcggccacaaggatggccccagtgtgcagaactttagcaaccctcacgaaccctggaaccggctgcaccgaacgcctccgtcgttcccgacccctccgccctggctgaagccaggggagctggagcgcagcgcgtccgctgcagctcatgacagagatagagatgtagataaacgagactcatctgttagtaaagatgacaaagaaagggaaagcgtcgagaagagacactccagccacccttcaccagcacctgtcctcccggtgaatgccctgggacatacccgcagctccactgaacagatccgggctcatctgaacactgaggctcgggagaaggacaaacccaaagagagggagagagaccactcggaatcccgcaaggacctggccgccgacgagcacaaggcgaaagagggccacctgcccgagaaggacgggcacggccacgaggggcgcgccgcgggcgaagaggccaagcagctggcccgggtgccgtctccctacgtgcggaccccggtggtggagagtgccaggcccaacagcacctcgagccgggaggccgagccgcgcaagggtgagccggcctacgagaaccccaagaagagctccgaggtcaaggtgaaggaggagcggaaggaagaccatgacctgcctccagaggccccgcagacccaccgggcctcggagccgccgcctcccaactcctcgtccagcgtgcacccggggcccctggcctcgatgcccatgacggtgggggtgacgggcattcaccccatgaacagcatcagcagcctggacaggactcgcatgatgacccccttcatgggcatcagccccctcccgggcggagagcgcttcccgtacccttctttccactgggaccccatccgggaccccttgagggatccttaccgagaacttgacattcaccggagagacccgctgggcagggacttcctgctaaggaacgacccgctccaccggctctcgactccccggctgtacgaagccgaccgctccttcagggaccgggagcctcacgactacagccaccaccaccaccaccaccaccacccgctgtctgtggaccctcggcgggagcacgagcggggaggccacctggacgagcgggagcgcttgcacatgctcagagaagactacgagcacacgcggctccactccgtgcaccccgcctccctcgacggacacctcccccaccccagcctcatcaccccgggactccccagcatgcactatccccgcatcagccccaccgcgggcaaccagaacggactcctcaacaagacccctccgacagcagcgctgagcgcacctcccccgctcatctccacgctggggggccgcccggtctctcccagaaggacgactcctctgtccgcagagataagggagaggcccccttcccacacgctgaaggatatcgaggcccgataagccgagaacaggagcaagaacgaggaagaagaaaccctaggcagacaccaggccaggcttgagagacagaactcctgcatggctcacacagactgggggggaaagccccaccccttccccttgtaaaaaatgtatagactcagtgcacattttgaaatgttttgtatattatatgttgagatttttcagatcttttagcccagtcatatgttctcacgtctcctactttttgtttctcgtataaaactttttgatttgaaccaaaacagtgaagatgacaacacacaccaattggatgataattgtagcgggggcggtgggggggagaagtccacgccatccatcatgcaaaattctttcagatgaggtgggaaggccgtgtacatagttatgtaaaaagagattgcttcatgagctaatggttcatatatgcaaaagggtaagatgaaagctttactttgtacaaatgtaaatagataaagtaacataatacattaatacttcttaaaatgtgctatttgcaaacttacttaatatcagtgaacacagtcggctaaagctgtgttcccatatattgttatagacagctaaacccttcaactatgcaatgaatgttcgggcttttcacaaaagcccgcctaactcaaaggagccttttcaaatccatttacagcatacttaaggtcatattttccctgaacaagcgcttacgtgatatgactctgttttccttgcttgttttttttcaaacggagaaacatcctgttttgcaaattggaccccaggctggaacttagcatctgaagttgccgcttgtgggctctgggggaaagtgtagccccggagaggtaactgaggacatgagcaaccagtgccagggagggtgggatttgccagatgccaaaatcaggggacgggtggtggtgtctgtcagacacacacaggtcgccagtgacttcacacacacctcatgtgagaaccatgccttttttagtgtgtcctatttcatacctgtacacacttcctcgttttgtaatgagatttacttacacccaaacagatcctgaaagaaagcttcaagttttctcagatgatggatatgttttcactgtattcaataactgacggatgtaaggtgcacgtttcctgatgtgacgcactgtattccagctggtgatcaagtctgggaacagccgtaacaggtcaaccttgtggagccatcgcgagttagagggtgaaagatggcagaaaaaaaagtcttgtgtgtgagtgtgttttttgagtttgcatcaatcttaatgtctcttcataatacttttataatacattaagcctcttgtctacatatttggagagaatatgactttactagcagagaaatacaatatatcttgtctactggactgtaaaatatatgtatgaaataaaattagttccatttggtcttctagtat

SEQ ID NO: 437175 - DNA, 1780 bp, Homo sapiens
cattgatggatttgccatgaccagctttgtcacttttgaagcgctggagaaagatgtagcacttaagcctcaggaacgtgtggagaaacgccagacgcccctgaccaagaagaaacgagaagcacttaccaatggcttgtcctttcattcaaagaagagcagactcagccacccacaccactacagctcagatcgagaaaatgaccgcaatctctgccagcaccttgggaagagaaagaaaatgccgaaggcactcagacagctcaagccaggacagaacagctgcagggacagtgacagtgaaagtgccagtggagaatccaagggcttccaccggagcagctctcgggaaaggctcagtgatagttcagctccttccagcttgggaacaggctacttctgtgacagtgacagtgaccaggaagagaaggcatcagatgccagctctgaaaaactcttcaacactgttattgtaaacaaagatccggagttaggtgttggcacgctaccagaacatgacagccaggatgcagggccgattgtccccaagatatcgggtctagagagaagccaggagaagagccaggactgttgcaaagagccaatctttgagcctgtggtgcttaaagacccctgccctcaggtcgcacagccaataccccagccgcagacggagccccaactccgagctccttctccggaccctgacttggtgcagcgcacagaggccccacctcaacccccacctctgagtacacagccaccacagggccctcctgaggcccagctccagcctgccccgcagcctcaggtgcagaggccacccaggccacagtcccccacccagctgctccatcagaacctcccacctgtgcaggcccacccctctgctcagagcctctcccagccattgtcagcctacaacagcagtagcttaagcctcaacagtttaagcagcagcagaagcagcactccagcgaagactcagcccgccccacctcacatctcccaccacccctctgcctccccgttccccctctccctgcccaaccacagccccctgcacagcttcacacccaccctccagccccccgcacactcacatcaccccaatatgtttgcccctcccactgctctgcctcctccaccaccactgacatcaggaagtctgcaggtggccggacacccggccgggagcacttactcagagcaagacatcttgcgacaggaactgaacactcgttttttggcctctcagagtgctgaccgcggggcttccctgggccctccgccctacctgcggaccgagttccatcagcaccagcaccagcaccagcacacccaccagcacacgcaccagcacaccttcacgccgttcccccacgccatcccacccaccgccatcatgccgacgccagcacctcccatgtttgacaaataccctacaaaagttgacccattctaccggcacagtgatccctcctgtttttgaaatgcattaaaatctccaatcatttaggacttctatctgatttaacaattaataattagaaaagctccctttctaatgatgccctcacccgggatgtcatttgctggctgattgatcctgaactacttttaactttttaagttacacattcgtggcacgtctgtgtgatcattccatcatggcttcttgactaatggcatcaaactgagattacgtggcttgctcatgtcgatgtctttctatgggacgggaatttgaatatgtcacttgcctcctactaaaatcttt

SEQ ID NO: 437176 - DNA, 6901 bp, Homo sapiens
tcgaccgcccagccaggtgcaaaatgccgtgtcattgggagactccgcagccggagcattagattacagctcgacggagctcgggaagggcggcgggggtggaagatgagcagaagcccctgttctcggaacgccggctgacaagcggggtgagcgcaggcggggcggggacccagcctagcccactggagcagccgggggtggcccgttcccctttaagagcaactgctctaagccaggagccagagattcgagccggcctcgcccagccagccctctccagcgaggggacccacaagcggcgcctcggccctcccgacctttccgagccctctttgcgccctgggcgcacggggccctacacgcgccaagcatgctgagggtcttcatcctctatgccgagaacgtccacacacccgacaccgacatcagcgatgcctactgctccgcggtgtttgcaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcagacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagaggagcctgcaggtgctgtcaagccttcgaaagcctcagacttggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctctgtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccaggaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccagagttgctaacatggagctctgagatcaccccacttccatcatttccttctcccccaacccaacgcttttttggatcagctcagacatatttcagtataaaacagttggaaccacacagcagtgtcagtg

SEQ ID NO: 437177 - DNA, 855 bp, Homo sapiens
ggacgtatgttgtcaagttgcatcttttctgcctccctgctcacatctgtctgtctcctctcattgcttgcctgttcggttttgtccttagaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaagggtgagccagcaggtggtgggtgggagtgaggcctgtggtcacaggtggccagtaggcacagatgcagacctgcatgcccacagacacatgcatgtgtgcacacagcatgcacagacacctgggactcactggaggtgctcacagatcacacccagcatacccaaagatcacacccagcatacacacagatcacacccagcatacccaaagatcacacccagcatacacacagatcacacccagcacacagatcacactgggaacacccacagatcacactcagcacacacacagattacacccagcacacacacagatcacacccagcacacagattacacccagcacacacacagatcacacccagcacacagatcacacccacagatcacacccagcgcatgcacagatcacacccagcacacccaaagatcacacccagcacacacacacagatcacacccaacacacccacagttcacactcagcacacacagatcacacccaacacaccc

SEQ ID NO: 437178 - DNA, 5209 bp, Homo sapiens
tagcaggctggtacggtcggaatttaggatcaggccctctctgctcccttgctctagggaccgcctgactcacaatgacatcgtggctaccacctacctgagtatgtcgaaaatctctgcccctggaggagaaatagaagtggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctctgtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccagcttgcagacggtctgtcgagcttggcccccactaacacggcttctcctccatccagtcctcatgaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccagagttgctaacatggagctctgagatcaccccacttccatcatttccttctcccccaacccaacgcttttttggatcagctcagacatatttcagtataaaacagttggaaccacacagcagtgtcagtg

SEQ ID NO: 437179 - DNA, 3757 bp, Homo sapiens
ggacgtatgttgtcaagttgcatcttttctgcctccctgctcacatctgtctgtctcctctcattgcttgcctgttcggttttgtccttagaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccagcttgcagacggtctgtcgagcttggcccccactaacacggcttctcctccatccagtcctcatgaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccagagttgctaacatggagctctgagatcaccccacttccatcatttccttctcccccaacccaacgcttttttggatcagctcagacatatttcagtataaaacagttggaaccacacagcagtgtcagtg

SEQ ID NO: 437180 - DNA, 2832 bp, Homo sapiens
aggacagatgataacccggaagggtctgagccaggaggcaggagaaccaggctggcgggcaggcacatggtcctctctgggactgagaggggctgaagtggatctgccaggatggaataggcagtgtgtgcacgcatatgctgttctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccagcttgcagacggtctgtcgagcttggcccccactaacacggcttctcctccatccagtcctcatgaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccagagttgctaacatggagctctgagatcaccccacttccatcatttccttctcccccaacccaacgcttttttggatcagctcagacatatttcagtataaaacagttggaaccacacagcagtgtcagtg

SEQ ID NO: 437181 - DNA, 2061 bp, Homo sapiens
gtcgcgtaccttgcttgatatggatttcgacaccctgtgtgtctctgacatcacatgattcggaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccagagttgctaacatggagctctgagatcaccccacttccatcatttccttctcccccaacccaacgcttttttggatcagctcagacatatttcagtataaaacagttggaaccacacagcagtgtcagtg

SEQ ID NO: 437182 - DNA, 1641 bp, Homo sapiens
tagcaggctggtacggtcggaatttaggatcaggccctctctgctcccttgctctagggaccgcctgactcacaatgacatcgtggctaccacctacctgagtatgtcgaaaatctctgcccctggaggagaaatagaagtggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccagagttgctaacatggagctctgagatcaccccacttccatcatttccttctcccccaacccaacgcttttttggatcagctcagacatatttcagtataaaacagttggaaccacacagcagtgtcagtg

SEQ ID NO: 437183 - DNA, 4020 bp, Homo sapiens
tcgaccgcccagccaggtgcaaaatgccgtgtcattgggagactccgcagccggagcattagattacagctcgacggagctcgggaagggcggcgggggtggaagatgagcagaagcccctgttctcggaacgccggctgacaagcggggtgagcgcaggcggggcggggacccagcctagcccactggagcagccgggggtggcccgttcccctttaagagcaactgctctaagccaggagccagagattcgagccggcctcgcccagccagccctctccagcgaggggacccacaagcggcgcctcggccctcccgacctttccgagccctctttgcgccctgggcgcacggggccctacacgcgccaagcatgctgagggtcttcatcctctatgccgagaacgtccacacacccgacaccgacatcagcgatgcctactgctccgcggtgtttgcaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcagacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagtggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctctgtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaagggtgagccagcaggtggtgggtgggagtgaggcctgtggtcacaggtggccagtaggcacagatgcagacctgcatgcccacagacacatgcatgtgtgcacacagcatgcacagacacctgggactcactggaggtgctcacagatcacacccagcatacccaaagatcacacccagcatacacacagatcacacccagcatacccaaagatcacacccagcatacacacagatcacacccagcacacagatcacactgggaacacccacagatcacactcagcacacacacagattacacccagcacacacacagatcacacccagcacacagattacacccagcacacacacagatcacacccagcacacagatcacacccacagatcacacccagcgcatgcacagatcacacccagcacacccaaagatcacacccagcacacacacacagatcacacccaacacacccacagttcacactcagcacacacagatcacacccaacacaccc

SEQ ID NO: 437184 - DNA, 349 bp, Homo sapiens
ccttgcatccttctctgttcctcttccgggtcaggatgatgccttctggaggctggacaagactgagagcaaaatcccagcacgagtggtgttccagatctgggacaatgacaagttctcctttgatgattttctgggtaagcgctattgctagaatcccattctgcacatgggggctgccccagaacccacactgtgtgtttatgccactgttggacccttggggaagcctagcaggaggagtgatcccactttctgctttcagggagctcagggtcatgtgtccccagtgttaagtgaggtgtatgacacacagcagtgtcagagtgattggtggccactgagggtg

SEQ ID NO: 437185 - DNA, 445 bp, Homo sapiens
tttgtacatcgtgccgatttcctgggaattctttttgcgataagctcatttaccttcttaactccttgtctgcctaagttgacgatgtatatactgtgttggaaatcttaatgagaactattctctaaaaacatgtatgtctagttggatgattggctttgaagaacacaagcaaaagacagacgtgcattatcgttccctgggaggtgaaggcaacttcaactggaggttcattttccccttcgactacctgccagctgagcaagtctgtaccattgccaagaaggtcagtgtccttccgattccctgtggtgccagcaccagggcttctaaagttagcctgacctgaccaccacgtccctgcctggcaactgtcacaatctcactgctgccccaccatgttggagctaccactgccatctccacatggccaccacctccactg

SEQ ID NO: 437186 - DNA, 2118 bp, Homo sapiens
tcgaccgcccagccaggtgcaaaatgccgtgtcattgggagactccgcagccggagcattagattacagctcgacggagctcgggaagggcggcgggggtggaagatgagcagaagcccctgttctcggaacgccggctgacaagcggggtgagcgcaggcggggcggggacccagcctagcccactggagcagccgggggtggcccgttcccctttaagagcaactgctctaagccaggagccagagattcgagccggcctcgcccagccagccctctccagcgaggggacccacaagcggcgcctcggccctcccgacctttccgagccctctttgcgccctgggcgcacggggccctacacgcgccaagcatgctgagggtcttcatcctctatgccgagaacgtccacacacccgacaccgacatcagcgatgcctactgctccgcggtgtttgcaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcagacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccagagttgctaacatggagctctgagatcaccccacttccatcatttccttctcccccaacccaacgcttttttggatcagctcagacatatttcagtataaaacagttggaaccacacagcagtgtcagtg

SEQ ID NO: 437187 - DNA, 6922 bp, Homo sapiens
tcgaccgcccagccaggtgcaaaatgccgtgtcattgggagactccgcagccggagcattagattacagctcgacggagctcgggaagggcggcgggggtggaagatgagcagaagcccctgttctcggaacgccggctgacaagcggggtgagcgcaggcggggcggggacccagcctagcccactggagcagccgggggtggcccgttcccctttaagagcaactgctctaagccaggagccagagattcgagccggcctcgcccagccagccctctccagcgaggggacccacaagcggcgcctcggccctcccgacctttccgagccctctttgcgccctgggcgcacggggccctacacgcgccaagcatgctgagggtcttcatcctctatgccgagaacgtccacacacccgacaccgacatcagcgatgcctactgctccgcggtgtttgcaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcagacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagtggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctctgtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccagcttgcagacggtctgtcgagcttggcccccactaacacggcttctcctccatccagtcctcatgaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccagagttgctaacatggagctctgagatcaccccacttccatcatttccttctcccccaacccaacgcttttttggatcagctcagacatatttcagtataaaacagttggaaccacacagcagtgtcagtg

SEQ ID NO: 437188 - DNA, 3312 bp, Homo sapiens
gaaatggagcaggcgacagtttgggtagtgggcaggagggagaggagagaggcacatggagaaatttgaggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccagcttgcagacggtctgtcgagcttggcccccactaacacggcttctcctccatccagtcctcatgaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccagagttgctaacatggagctctgagatcaccccacttccatcatttccttctcccccaacccaacgcttttttggatcagctcagacatatttcagtataaaacagttggaaccacacagcagtgtcagtg

SEQ ID NO: 437189 - DNA, 3198 bp, Homo sapiens
ccgagtctctgggggcagcacccagcagcctgaatgaaccttccagatgatcctgcagcatgctcacattttcagaaccactgccctagagtctgctctagtgacaccaacttgcctttgggacaagatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccagcttgcagacggtctgtcgagcttggcccccactaacacggcttctcctccatccagtcctcatgaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccagagttgctaacatggagctctgagatcaccccacttccatcatttccttctcccccaacccaacgcttttttggatcagctcagacatatttcagtataaaacagttggaaccacacagcagtgtcagtg

SEQ ID NO: 437190 - DNA, 6880 bp, Homo sapiens
tcgaccgcccagccaggtgcaaaatgccgtgtcattgggagactccgcagccggagcattagattacagctcgacggagctcgggaagggcggcgggggtggaagatgagcagaagcccctgttctcggaacgccggctgacaagcggggtgagcgcaggcggggcggggacccagcctagcccactggagcagccgggggtggcccgttcccctttaagagcaactgctctaagccaggagccagagattcgagccggcctcgcccagccagccctctccagcgaggggacccacaagcggcgcctcggccctcccgacctttccgagccctctttgcgccctgggcgcacggggccctacacgcgccaagcatgctgagggtcttcatcctctatgccgagaacgtccacacacccgacaccgacatcagcgatgcctactgctccgcggtgtttgcaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcagacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagtggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctctgtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccagcttgcagacggtctgtcgagcttggcccccactaacacggcttctcctccatccagtcctcatgaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccagagttgctaacatggagctctgagatcaccccacttccatcatttccttctcccccaacccaacgcttttttggatcagctcagacatatttcagtataaaacagttggaaccacacagcagtgtcagtg

SEQ ID NO: 437191 - DNA, 6186 bp, Homo sapiens
tcgaccgcccagccaggtgcaaaatgccgtgtcattgggagactccgcagccggagcattagattacagctcgacggagctcgggaagggcggcgggggtggaagatgagcagaagcccctgttctcggaacgccggctgacaagcggggtgagcgcaggcggggcggggacccagcctagcccactggagcagccgggggtggcccgttcccctttaagagcaactgctctaagccaggagccagagattcgagccggcctcgcccagccagccctctccagcgaggggacccacaagcggcgcctcggccctcccgacctttccgagccctctttgcgccctgggcgcacggggccctacacgcgccaagcatgctgagggtcttcatcctctatgccgagaacgtccacacacccgacaccgacatcagcgatgcctactgctccgcggtgtttgcaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcagacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagtggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctctgtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccagcttgcagacggtctgtcgagcttggcccccactaacacggcttctcctccatccagtcctcatgaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggtcagtgtccttccgattccctgtggtgccagcaccagggcttctaaagttagcctgacctgaccaccacgtccctgcctggcaactgtcacaatctcactgctgccccaccatgttggagctac

SEQ ID NO: 437192 - DNA, 405 bp, Homo sapiens
gccccatccccggcaagctctcaagccatgctggtggggacgactgaatgccagggcccttcactgggctatttcacccagggacgcttcttgaaggcaccccccactccaagctgcaaattaggaccgagagtcagtggccgctcaagagtctgtgaccatgccccaaattcagagatggtcccaggagagatggggggaactgccaagcaatgagtgaccggttccccctcccccaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaagggtgagccagcaggtggtgggtgg

SEQ ID NO: 437193 - DNA, 1166 bp, Homo sapiens
cgctcgaggggtcgagcctgggcagtacaggcggcggtgcgcactctgcggcggcctctgcgcctcgggcgggcgggagagagaggccgcggccgccagcgtggggatgtctaggagctcgaaggtggtgctgggcctctcggtgctgctgacggcggccacagtggccggcgtacatgtgaagcagcagtgggaccagcagaggcttcgtgacggagttatcagagacattgagaggcaaattcggaaaaaagaaaacattcgtcttttgggagaacagattattttgactgagcaacttgaagcagaaagagagaagatgttattggcaaaaggatctcaaaaatcatgacttgaatgtgaaatatctgttggacagacaacacgagtttgtgtgtgtgtgttgatggagagtagcttagtagtatcttcatctttttttttggtcactgtccttttaaacttgatcaaataaaggacagtgggtcatataagttactgctttcagggtcccttatatctgaataaaggagtgtgggcagacactttttggaagagtctgtctgggtgatcctggtagaagccccattagggtcactgtccagtgcttagggttgttactgagaagcactgccgagcttgtgagaaggaagggatggatagtagcatccacctgagtagtctgatcagtcggcatgatgacgaagccacgagaacatcgacctcagaaggactggaggaaggtgaagtggagggagagacgctcctgatcgtcgaatccgaggatcaggcatcagtggacttatcgcacgaccagagtggggattccctcaacagtgatgaaggagacgtgtcttggatggaggagcagctgtcctacttctgtgacaagtgccaaaaatggataccagccagtaaggagcttctcaattcctttgatttgtcaattcctgtgtgaaggtttgtttttccaacctgtgaaagaaacgtgaatgtaaaagagacctaaataaaaggataattatatttattctctagttgatcagctataaatttatataaaacataggcatgtttgtactaatgaaacgtactgtcaacctctatcacattgttaaattaacacttttggtggtaactcaataaaattgagaaaattggaaaaa

SEQ ID NO: 437194 - DNA, 3936 bp, Homo sapiens
cgctcgaggggtcgagcctgggcagtacaggcggcggtgcgcactctgcggcggcctctgcgcctcgggcgggcgggagagagaggccgcggccgccagcgtggggatgtctaggagctcgaaggtggtgctgggcctctcggtgctgctgacggcggccacagtggccggcgtacatgtgaagcagcagtgggaccagcagaggcttcgtgacggagttatcagagacattgagaggcaaattcggaaaaaagaaaacattcgtcttttgggagaacagattattttgactgagcaacttgaagcagaaagagagaagatgttattggcaaaaggatctcaaaaatcatgacttgaatgtgaaatatctgttggacagacaacacgagtttgtgtgtgtgtgttgatggagagtagcttagtagtatcttcatctttttttttggtcactgtccttttaaacttgatcaaataaaggacagtgggtcatataagttactgctttcagggtcccttatatctgaataaaggagtgtgggcagacactttttggaagagtctgtctgggtgatcctggtagaagccccattagggtcactgtccagtgcttagggttgttactgagaagcactgccgagcttgtgagaaggaagggatggatagtagcatccacctgagtagtctgatcagtcggcatgatgacgaagccacgagaacatcgacctcagaaggactggaggaaggtgaagtggagggagagacgctcctgatcgtcgaatccgaggatcaggcatcagtggacttatcgcacgaccagagtggggattccctcaacagtgatgaaggagacgtgtcttggatggaggagcagctgtcctacttctgtgacaagtgccaaaaatggataccagccagtcagctgagggaacagctcagttaccttaagggtgataatttttttaggtttacttgttcggattgctcagcagatggcaaggagcagtatgaaaggctgaagctgacatggcagcaagtcgtcatgttggcaatgtacaacttgtctctggaaggaagtggacgtcaaggttatttcaggtggaaagaagatatctgtgcttttattgagaaacattggacttttttactagggaataggaaaaagacgtctacctggtggagcaccgtggcaggttgcctcagcgtgggaagtcccatgtacttccgttcaggtgctcaggaatttggagagccaggatggtggaaacttgttcataacaagcccccaacgatgaaacctgaaggagagaagttgtctgcctctactttgaaaataaaagcagcctcaaaaccaactttagatcccatcattactgttgagggacttagaaaacgagcaagtcggaatcctgtggaatctgccatggaattaaaagagaaaaggtctcgaactcaggaagcaaaagacattagaagagcccagaaggaggccgctggctttcttgacaggagcacatcttctacccctgtaaaattcataagccgaggccgcaggccagatgtgattctggaaaaaggcgaagtgattgacttttcctccttgagctcctctgaccgcaccccgctgacaagcccatctccttctccttctctggatttctctgcccctggtacacctgcctctcattctgccacacctagcttgctttcagaagcagatctgattccagatgtgatgcccccacaagccttgtttcatgatgacgatgagatggaaggcgatggagtcatagacccagggatggagtacgtcccaccccctgctgggtcagtagcttctgggccagtggttgggggcagaaagaaggtcagaggccctgaacagataaagcaggaggtagagagtgaggaggaaaaacccgacaggatggatattgacagtgaagacacagattcaaacacatctttgcaaacaagggctagagaaaagaggaagcctcagctggagaaggacacaaagccgaaagagcccaggtatactcccgtgagcatctacgaggaaaagctgctgctcaagaggctggaagcttgtcccggtgctgttgccatgactccggaagctcggagactgaaacgcaaactgattgtcagacaagcgaaaagggataggggattaccactttttgacttggatcaagttgttaatgctgctcttttgttagttgacgggatttatggagccaaagaaggaggaatttccagacttccagctggacaagccacgtacagaaccacctgtcaggacttcagaatccttgaccgataccagacttccttgccgtccaggaagggatttcgacaccagaccaccaagtttttgtatcgcttggtaggatcagaagatatggctgtggaccagagtattgtcagcccttatacctctcggatcttgaaaccttatatcaggcgtgattatgaaacaaagccacccaaactgcagctcctgtcacagattcgttcccacctgcacaggagcgaccctcactggacgccggagcccgacgcacctctcgattactgttatgtgcggccaaatcacatcccaacgatcaactccatgtgtcaggagtttttttggcctggcattgacctgtctgagtgtctgcagtacccagacttcagtgttgttgttctttataaaaaagtcatcattgcctttggcttcatggttcctgatgtgaaatacaatgaagcttacatttcatttctgttcgtccaccctgaatggagaagagcagggattgcaactttcatgatctatcatctgattcagacctgcatgggcaaggacgtaacccttcacgtctcagcaagcaaccccgctatgctactgtaccagaagtttggattcaagactgaagaatatgtattagatttctatgataaatattacccattggagagtacagagtgtaaacacgcattctttctgaggctccggcgctgatgcgaatacagctcacagagaaacgcatgtgctattggagaacaggtctttgtggagatctaaaggcagtgattgatttcacagggagctctaatctctgtgattacatggtccttcaaactcccaaccaaagtgagaaaagcggcatgcagtgaaatgagcagtgagcagccctttagcaaaatcgccctccagtccttcctggagatgccttcagccagcatcccagactccacagttatttatgaatgatgtcgtgattctccctccacctgacagtttgtaagagtgaaagagcatctaacctgatgctcttggagagagataacctgtctgtcataacttaaaggatgagaaaatgtggtgtagctattaaagattcatgcagtcccaaaaggcactgtcctgggatgatgagagattataaggtgatttcataaaaggaatccaaccctgtgcccggccattgatgtgttgtcattgaatccaggaggatttctagggcactgaagttttgttgtttcttttgctgactttggttacagtcagaaaaaataaactagatgtttgtgtctacatgttctacctgttgtacctattagcatcttcctgcagggacttgggcccatggcctgggaggttggtttgggattggggttgttgggcagcctgccattcacctggcctatcctggcccttctcatgcccaagacagttgtttcacaggagtggaagtgtgggtgatgcaagtagaaccctctagatgtaccctgtgtggtctgcaggactggactgtttgctgtgtttgtggatgttggcgatagactgtcaattaggttgtttgtgatccaacaagaacatttccaaaagtatctaggtgttctcaaataaaaagctttctttgcacaacccatggccagagcgtcaaaaaa

SEQ ID NO: 437195 - DNA, 4061 bp, Homo sapiens
ctctgcccgctcggttcctcagctcctcttcgtgtctttcccccgcggtggcgcggccctgcaccccacgcgtttgcggctgcggccggcggccgctctgctgggctccgggcgctgcagctcccggcgggcgtgtgcagcccgcagattcaggacgacccggctgcccggcttagcgcctttggagctccgcgctgaaggggccttgctccgcacaggcacggcacgcaagcttttggggtgcccagtggctctgttttcaagtcacagccggcccgcagggtgcggacctttccacatctcacttgggccgctagaaaatagaagaggcttcgtgacggagttatcagagacattgagaggcaaattcggaaaaaagaaaacattcgtcttttgggagaacagattattttgactgagcaacttgaagcagaaagagagaagatgttattggcaaaaggatctcaaaaatcatgacttgaatgtgaaatatctgttggacagacaacacgagtttgtgtgtgtgtgttgatggagagtagcttagtagtatcttcatctttttttttggtcactgtccttttaaacttgatcaaataaaggacagtgggtcatataagttactgctttcagggtcccttatatctgaataaaggagtgtgggcagacactttttggaagagtctgtctgggtgatcctggtagaagccccattagggtcactgtccagtgcttagggttgttactgagaagcactgccgagcttgtgagaaggaagggatggatagtagcatccacctgagtagtctgatcagtcggcatgatgacgaagccacgagaacatcgacctcagaaggactggaggaaggtgaagtggagggagagacgctcctgatcgtcgaatccgaggatcaggcatcagtggacttatcgcacgaccagagtggggattccctcaacagtgatgaaggagacgtgtcttggatggaggagcagctgtcctacttctgtgacaagtgccaaaaatggataccagccagtcagctgagggaacagctcagttaccttaagggtgataatttttttaggtttacttgttcggattgctcagcagatggcaaggagcagtatgaaaggctgaagctgacatggcagcaagtcgtcatgttggcaatgtacaacttgtctctggaaggaagtggacgtcaaggttatttcaggtggaaagaagatatctgtgcttttattgagaaacattggacttttttactagggaataggaaaaagacgtctacctggtggagcaccgtggcaggttgcctcagcgtgggaagtcccatgtacttccgttcaggtgctcaggaatttggagagccaggatggtggaaacttgttcataacaagcccccaacgatgaaacctgaaggagagaagttgtctgcctctactttgaaaataaaagcagcctcaaaaccaactttagatcccatcattactgttgagggacttagaaaacgagcaagtcggaatcctgtggaatctgccatggaattaaaagagaaaaggtctcgaactcaggaagcaaaagacattagaagagcccagaaggaggccgctggctttcttgacaggagcacatcttctacccctgtaaaattcataagccgaggccgcaggccagatgtgattctggaaaaaggcgaagtgattgacttttcctccttgagctcctctgaccgcaccccgctgacaagcccatctccttctccttctctggatttctctgcccctggtacacctgcctctcattctgccacacctagcttgctttcagaagcagatctgattccagatgtgatgcccccacaagccttgtttcatgatgacgatgagatggaaggcgatggagtcatagacccagggatggagtacgtcccaccccctgctgggtcagtagcttctgggccagtggttgggggcagaaagaaggtcagaggccctgaacagataaagcaggaggtagagagtgaggaggaaaaacccgacaggatggatattgacagtgaagacacagattcaaacacatctttgcaaacaagggctagagaaaagaggaagcctcagctggagaaggacacaaagccgaaagagcccaggtatactcccgtgagcatctacgaggaaaagctgctgctcaagaggctggaagcttgtcccggtgctgttgccatgactccggaagctcggagactgaaacgcaaactgattgtcagacaagcgaaaagggataggggattaccactttttgacttggatcaagttgttaatgctgctcttttgttagttgacgggatttatggagccaaagaaggaggaatttccagacttccagctggacaagccacgtacagaaccacctgtcaggacttcagaatccttgaccgataccagacttccttgccgtccaggaagggatttcgacaccagaccaccaagtttttgtatcgcttggtaggatcagaagatatggctgtggaccagagtattgtcagcccttatacctctcggatcttgaaaccttatatcaggcgtgattatgaaacaaagccacccaaactgcagctcctgtcacagattcgttcccacctgcacaggagcgaccctcactggacgccggagcccgacgcacctctcgattactgttatgtgcggccaaatcacatcccaacgatcaactccatgtgtcaggagtttttttggcctggcattgacctgtctgagtgtctgcagtacccagacttcagtgttgttgttctttataaaaaagtcatcattgcctttggcttcatggttcctgatgtgaaatacaatgaagcttacatttcatttctgttcgtccaccctgaatggagaagagcagggattgcaactttcatgatctatcatctgattcagacctgcatgggcaaggacgtaacccttcacgtctcagcaagcaaccccgctatgctactgtaccagaagtttggattcaagactgaagaatatgtattagatttctatgataaatattacccattggagagtacagagtgtaaacacgcattctttctgaggctccggcgctgatgcgaatacagctcacagagaaacgcatgtgctattggagaacaggtctttgtggagatctaaaggcagtgattgatttcacagggagctctaatctctgtgattacatggtccttcaaactcccaaccaaagtgagaaaagcggcatgcagtgaaatgagcagtgagcagccctttagcaaaatcgccctccagtccttcctggagatgccttcagccagcatcccagactccacagttatttatgaatgatgtcgtgattctccctccacctgacagtttgtaagagtgaaagagcatctaacctgatgctcttggagagagataacctgtctgtcataacttaaaggatgagaaaatgtggtgtagctattaaagattcatgcagtcccaaaaggcactgtcctgggatgatgagagattataaggtgatttcataaaaggaatccaaccctgtgcccggccattgatgtgttgtcattgaatccaggaggatttctagggcactgaagttttgttgtttcttttgctgactttggttacagtcagaaaaaataaactagatgtttgtgtctacatgttctacctgttgtacctattagcatcttcctgcagggacttgggcccatggcctgggaggttggtttgggattggggttgttgggcagcctgccattcacctggcctatcctggcccttctcatgcccaagacagttgtttcacaggagtggaagtgtgggtgatgcaagtagaaccctctagatgtaccctgtgtggtctgcaggactggactgtttgctgtgtttgtggatgttggcgatagactgtcaattaggttgtttgtgatccaacaagaacatttccaaaagtatctaggtgttctcaaataaaaagctttctttgcacaacccatggccagagcgtcaaaaaa

SEQ ID NO: 437196 - DNA, 4121 bp, Homo sapiens
ctctgcccgctcggttcctcagctcctcttcgtgtctttcccccgcggtggcgcggccctgcaccccacgcgtttgcggctgcggccggcggccgctctgctgggctccgggcgctgcagctcccggcgggcgtgtgcagcccgcagattcaggacgacccggctgcccggcttagcgcctttggagctccgcgctgaaggggccttgctccgcacaggcacggcacgcaagcttttggggtgcccagtggctctgttttcaagtcacagccggcccgcagggtgcggacctttccacatctcacttgggccgctagaaaatagaaggtggggaaggagtttcttggggtgcattctgcaagctaccagcctccctcctggcccaagaggcttcgtgacggagttatcagagacattgagaggcaaattcggaaaaaagaaaacattcgtcttttgggagaacagattattttgactgagcaacttgaagcagaaagagagaagatgttattggcaaaaggatctcaaaaatcatgacttgaatgtgaaatatctgttggacagacaacacgagtttgtgtgtgtgtgttgatggagagtagcttagtagtatcttcatctttttttttggtcactgtccttttaaacttgatcaaataaaggacagtgggtcatataagttactgctttcagggtcccttatatctgaataaaggagtgtgggcagacactttttggaagagtctgtctgggtgatcctggtagaagccccattagggtcactgtccagtgcttagggttgttactgagaagcactgccgagcttgtgagaaggaagggatggatagtagcatccacctgagtagtctgatcagtcggcatgatgacgaagccacgagaacatcgacctcagaaggactggaggaaggtgaagtggagggagagacgctcctgatcgtcgaatccgaggatcaggcatcagtggacttatcgcacgaccagagtggggattccctcaacagtgatgaaggagacgtgtcttggatggaggagcagctgtcctacttctgtgacaagtgccaaaaatggataccagccagtcagctgagggaacagctcagttaccttaagggtgataatttttttaggtttacttgttcggattgctcagcagatggcaaggagcagtatgaaaggctgaagctgacatggcagcaagtcgtcatgttggcaatgtacaacttgtctctggaaggaagtggacgtcaaggttatttcaggtggaaagaagatatctgtgcttttattgagaaacattggacttttttactagggaataggaaaaagacgtctacctggtggagcaccgtggcaggttgcctcagcgtgggaagtcccatgtacttccgttcaggtgctcaggaatttggagagccaggatggtggaaacttgttcataacaagcccccaacgatgaaacctgaaggagagaagttgtctgcctctactttgaaaataaaagcagcctcaaaaccaactttagatcccatcattactgttgagggacttagaaaacgagcaagtcggaatcctgtggaatctgccatggaattaaaagagaaaaggtctcgaactcaggaagcaaaagacattagaagagcccagaaggaggccgctggctttcttgacaggagcacatcttctacccctgtaaaattcataagccgaggccgcaggccagatgtgattctggaaaaaggcgaagtgattgacttttcctccttgagctcctctgaccgcaccccgctgacaagcccatctccttctccttctctggatttctctgcccctggtacacctgcctctcattctgccacacctagcttgctttcagaagcagatctgattccagatgtgatgcccccacaagccttgtttcatgatgacgatgagatggaaggcgatggagtcatagacccagggatggagtacgtcccaccccctgctgggtcagtagcttctgggccagtggttgggggcagaaagaaggtcagaggccctgaacagataaagcaggaggtagagagtgaggaggaaaaacccgacaggatggatattgacagtgaagacacagattcaaacacatctttgcaaacaagggctagagaaaagaggaagcctcagctggagaaggacacaaagccgaaagagcccaggtatactcccgtgagcatctacgaggaaaagctgctgctcaagaggctggaagcttgtcccggtgctgttgccatgactccggaagctcggagactgaaacgcaaactgattgtcagacaagcgaaaagggataggggattaccactttttgacttggatcaagttgttaatgctgctcttttgttagttgacgggatttatggagccaaagaaggaggaatttccagacttccagctggacaagccacgtacagaaccacctgtcaggacttcagaatccttgaccgataccagacttccttgccgtccaggaagggatttcgacaccagaccaccaagtttttgtatcgcttggtaggatcagaagatatggctgtggaccagagtattgtcagcccttatacctctcggatcttgaaaccttatatcaggcgtgattatgaaacaaagccacccaaactgcagctcctgtcacagattcgttcccacctgcacaggagcgaccctcactggacgccggagcccgacgcacctctcgattactgttatgtgcggccaaatcacatcccaacgatcaactccatgtgtcaggagtttttttggcctggcattgacctgtctgagtgtctgcagtacccagacttcagtgttgttgttctttataaaaaagtcatcattgcctttggcttcatggttcctgatgtgaaatacaatgaagcttacatttcatttctgttcgtccaccctgaatggagaagagcagggattgcaactttcatgatctatcatctgattcagacctgcatgggcaaggacgtaacccttcacgtctcagcaagcaaccccgctatgctactgtaccagaagtttggattcaagactgaagaatatgtattagatttctatgataaatattacccattggagagtacagagtgtaaacacgcattctttctgaggctccggcgctgatgcgaatacagctcacagagaaacgcatgtgctattggagaacaggtctttgtggagatctaaaggcagtgattgatttcacagggagctctaatctctgtgattacatggtccttcaaactcccaaccaaagtgagaaaagcggcatgcagtgaaatgagcagtgagcagccctttagcaaaatcgccctccagtccttcctggagatgccttcagccagcatcccagactccacagttatttatgaatgatgtcgtgattctccctccacctgacagtttgtaagagtgaaagagcatctaacctgatgctcttggagagagataacctgtctgtcataacttaaaggatgagaaaatgtggtgtagctattaaagattcatgcagtcccaaaaggcactgtcctgggatgatgagagattataaggtgatttcataaaaggaatccaaccctgtgcccggccattgatgtgttgtcattgaatccaggaggatttctagggcactgaagttttgttgtttcttttgctgactttggttacagtcagaaaaaataaactagatgtttgtgtctacatgttctacctgttgtacctattagcatcttcctgcagggacttgggcccatggcctgggaggttggtttgggattggggttgttgggcagcctgccattcacctggcctatcctggcccttctcatgcccaagacagttgtttcacaggagtggaagtgtgggtgatgcaagtagaaccctctagatgtaccctgtgtggtctgcaggactggactgtttgctgtgtttgtggatgttggcgatagactgtcaattaggttgtttgtgatccaacaagaacatttccaaaagtatctaggtgttctcaaataaaaagctttctttgcacaacccatggccagagcgtcaaaaaa

SEQ ID NO: 437197 - DNA, 3883 bp, Homo sapiens
cgctcgaggggtcgagcctgggcagtacaggcggcggtgcgcactctgcggcggcctctgcgcctcgggcgggcgggagagagaggccgcggccgccagcgtggggatgtctaggagctcgaaggtggtgctgggcctctcggtgctgctgacggcggccacagtggccggcgtacatgtgaagcagcagtgggaccagcagaggcttcgtgacggagttatcagagacattgagaggcaaattcggaaaaaagaaaacattcgtcttttgggagaacagattattttgactgagcaacttgaagcagaaagagagaagatgttattggcaaaaggatctcaaaaatcatgacttgaatgtgaaatatctgttggacagacaacacgagtttgtgtgtgtgtgttgatggagagtagcttagtagtatcttcatctttttttttggtcactgtccttttaaacttgatcaaataaaggacagtgggtcatataagttactgctttcagggtcccttatatctgaataaaggagtgtgggcagacactttttggaagagtctgtctgggtgatcctggtagaagccccattagggtcactgtccagtgcttagggttgttactgagaagcactgccgagcttgtgagaaggaagggatggatagtagcatccacctgagtagtctgatcagtcggcatgatgacgaagccacgagaacatcgacctcagaaggactggaggaaggtgaagtggagggagagacgctcctgatcgtcgaatccgaggatcaggcatcagtggacttatcgcacgaccagagtggggattccctcaacagtgatgaaggagacgtgtcttggatggaggagcagctgtcctacttctgtgacaagtgccaaaaatggataccagccagtcagctgagggaacagctcagttaccttaagggtgataatttttttaggtttacttgttcggattgctcagcagatggcaaggagcagtatgaaaggctgaagctgacatggcagcaagtcgtcatgttggcaatgtacaacttgtctctggaaggaagtggacgtcaaggttatttcaggtggaaagaagatatctgtgcttttattgagaaacattggacttttttactagggaataggaaaaagacgtctacctggtggagcaccgtggcaggttgcctcagcgtgggaagtcccatgtacttccgttcaggtgctcaggaatttggagagccaggatggtggaaacttgttcataacaagcccccaacgatgaaacctgaaggagagaagttgtctgcctctactttgaaaataaaagcagcctcaaaaccaactttagatcccatcattactgttgagggacttagaaaacgagcaagtcggaatcctgtggaatctgccatggaattaaaagagaaaaggtctcgaactcaggaagcaaaagacattagaagagcccagaaggaggccgctggctttcttgacaggagcacatcttctacccctgtaaaattcataagccgaggccgcaggccagatgtgattctggaaaaaggcgaagtgattgacttttcctccttgagctcctctgaccgcaccccgctgacaagcccatctccttctccttctctggatttctctgcccctggtacacctgcctctcattctgccacacctagcttgctttcagaagcagatctgattccagatgtgatgcccccacaagccttgtttcatgatgacgatgagatggaaggcgatggagtcatagacccagggatggagtacgtcccaccccctgctgggtcagtagcttctgggccagtggttgggggcagaaagaaggtcagaggccctgaacagataaagcaggaggtagagagtgaggaggaaaaacccgacaggatggatattgacagtgaagacacagattcaaacacatctttgcaaacaagggctagagaaaagaggaagcctcagctggagaaggacacaaagccgaaagagcccaggtatactcccgtgagcatctacgaggaaaagctgctgctcaagaggctggaagcttgtcccggtgctgttgccatgactccggaagctcggagactgaaacgcaaactgattgtcagacaagcgaaaagggataggggattaccactttttgacttggatcaagttgttaatgctgctcttttgttagttgacgggatttatggagccaaagaaggaggaatttccagacttccagctggacaagccacgtacagaaccacctgtcaggacttcagaatccttgaccgataccagacttccttgccgtccaggaagggatttcgacaccagaccaccaagtttttgtatcgcttggtaggatcagaagatatggctgtggaccagagtattgtcagcccttatacctctcggatcttgaaaccttatatcaggcgtgattatgaaacaaagccacccaaactgcagctcctgtcacagattcgttcccacctgcacaggagcgaccctcactggacgccggagcccgacgcacctctcgattactgttatgtgcggccaaatcacatcccaacgatcaactccatgtgtcaggagtttttttggcctggcattgacctgtctgagtgtctgcagtacccagacttcagtgttgttgttctttataaaaaagtcatcattgcctttggcttcatggttcctgatgtgaaatacaatgaagcttacatttcatttctgttcgtccaccctgaatggagaagagcagggattgcaactttcatgatctatcatctgattcagacctgcatgggcaaggacgtaacccttcacgtctcagcaagcaaccccgctatgctactgtaccagaagtttggattcaagactgaagaatatgtattagatttctatgataaatattacccattggagagtacagagtgtaaacacgcattctttctgaggctccggcgctgatgcgaatacagctcacagagaaacgcatgtgctattggagaacaggtctttgtggagatctaaaggcagtgattgatttcacagggagctctaatctctgtgattacatggtccttcaaactcccaaccaaagtgagaaaagcggcatgcagtgaaatgagcagtgagcagccctttagcaaaatcgccctccagtccttcctggagatgccttcagccagcatcccagactccacagttatttatgaatgatgtcgtgattctccctccacctgacagtttgtaagagtgaaagagcatctaacctgatgctcttggagagagataacctgtctgtcataacttaaaggatgagaaaatgtggtgtagctattaaagattcatgcagtcccaaaaggcactgtcctgggatgatgagagattataaggtgatttcataaaaggaatccaaccctgtgcccggccattgatgtgttgtcattgaatccaggaggatttctagggcactgaagttttgttgtttcttttgctgactttggttacagtcagaaacttcctgcagggacttgggcccatggcctgggaggttggtttgggattggggttgttgggcagcctgccattcacctggcctatcctggcccttctcatgcccaagacagttgtttcacaggagtggaagtgtgggtgatgcaagtagaaccctctagatgtaccctgtgtggtctgcaggactggactgtttgctgtgtttgtggatgttggcgatagactgtcaattaggttgtttgtgatccaacaagaacatttccaaaagtatctaggtgttctcaaataaaaagctttctttgcacaacccatggccagagcgtcaaaaaa

SEQ ID NO: 437198 - DNA, 2480 bp, Homo sapiens
gtaattaatatgtgctactttgggtggtggttttctcttgagagcttctcagttatttctacaacactccctttctctgccccatcccaaccaagagttgatctctcagtatgcgtctttttaacctaggagagcacttagaggatttgctgccgtatctgtcactggtaagggcctgaagacagggcacgaatagtactctgtccttgtgtgtgtgtgtccttggtgcccaacatgagggctggtacagagtcagtccctgctgagtgtttgcgaggccactggaggagtggttcatctttgcaggtgggcaccttcccctccagccagaccatacccctgagggcccaaacataggtggcgcacagtcgctggcactcaatgatggccacagtgagatcacgtatatttgcaatctagcaaacaccaatatgaccccacagaatttactttaaaaactcacaaagtgctcttgtccctggcatactggtaagtgctctcttgtcctaaaaatgcctatggatacacatggaagttaagcagagaaagcaggtagctatcagatgactgtcaacagaggagttcttagaggcctgagagaaccatgggttataaatctcaaggactctatcaacttcagtatttcagtgccttctttattaaaaagtaagttcttaaatgatatgacttttgggacaccttactctgtgtagctgattaaagaatctaaggacttgccttgtgttgatagaatgattgttactcttttcccctaagattaggtcaaagctgaatgtagaaatctcagttctaagaagctaattctgtcagttttagagagacagaaggtggactttgggattcagaaggtctatacaagggcctcaggttttataattacattcttaatatttcatgtttgtgcatgtaatttagcaggcctagtaaaggaatttttacaggttttggggaggtacaagataacatctagttttaaaaagcaaaacttattttgttttgtatttattcaaggttatcatagtgttaggtattgaaatgtttgacatatttaaaggtaattgagttgtaaataataaagctgacaataacaatatccccattgaccctttgcttcaaagaaaaataaaaaacacccagaatactatcagtttccttggtcttgtgaatgttttgatcagcagcaaaatgtcattctgtttccagctgttgctaggtgttgcaatgtctcagcctcagtctctgatttctccggtttccataactaactgcctacacttaaaagcgtttctttacctactcattttccctcaggcctttccatttttatcttgtatttttccactcttttggcagacctgcatgggcaaggacgtaacccttcacgtctcagcaagcaaccccgctatgctactgtaccagaagtttggattcaagactgaagaatatgtattagatttctatgataaatattacccattggagagtacagagtgtaaacacgcattctttctgaggctccggcgctgatgcgaatacagctcacagagaaacgcatgtgctattggagaacaggtctttgtggagatctaaaggcagtgattgatttcacagggagctctaatctctgtgattacatggtccttcaaactcccaaccaaagtgagaaaagcggcatgcagtgaaatgagcagtgagcagccctttagcaaaatcgccctccagtccttcctggagatgccttcagccagcatcccagactccacagttatttatgaatgatgtcgtgattctccctccacctgacagtttgtaagagtgaaagagcatctaacctgatgctcttggagagagataacctgtctgtcataacttaaaggatgagaaaatgtggtgtagctattaaagattcatgcagtcccaaaaggcactgtcctgggatgatgagagattataaggtgatttcataaaaggaatccaaccctgtgcccggccattgatgtgttgtcattgaatccaggaggatttctagggcactgaagttttgttgtttcttttgctgactttggttacagtcagaaaaaataaactagatgtttgtgtctacatgttctacctgttgtacctattagcatcttcctgcagggacttgggcccatggcctgggaggttggtttgggattggggttgttgggcagcctgccattcacctggcctatcctggcccttctcatgcccaagacagttgtttcacaggagtggaagtgtgggtgatgcaagtagaaccctctagatgtaccctgtgtggtctgcaggactggactgtttgctgtgtttgtggatgttggcgatagactgtcaattaggttgtttgtgatccaacaagaacatttccaaaagtatctaggtgttctcaaataaaaagctttctttgcacaacccatggccagagcgtcaaaaaa

SEQ ID NO: 437199 - DNA, 339 bp, Homo sapiens
ccatctccttctccttctctggatttctctgcccctggtacacctgcctctcattctgccacacctagcttgctttcagaagcagatctgattccagatgtgatgcccccacaagccttgtttcatggtaagagtttgtttgctttgctcttttattttgggtatgggccatggtataaatgtacaagttttcaccccgtgggctgtgtgctctgcatttcttccttcctatgtcttgatgacactgttttgtactctgcacagatgacgatgagatggaaggcgatggagtcatagacccagggatggagtacgtcccaccccctgctgggtcagtag

SEQ ID NO: 437200 - DNA, 3156 bp, Homo sapiens
attttgcaattgtgggttggctgaagaaaagaagacaacatgggaaaggaaaatctgggtgataaacggattaaacctttaggttaccgctgctctagataaacccatgatgtgactttttgtttttctcctaggtcagctgagggaacagctcagttaccttaagggtgataatttttttaggtttacttgttcggattgctcagcagatggcaaggagcagtatgaaaggctgaagctgacatggcagcaagtcgtcatgttggcaatgtacaacttgtctctggaaggaagtggacgtcaaggttatttcaggtggaaagaagatatctgtgcttttattgagaaacattggacttttttactagggaataggaaaaagacgtctacctggtggagcaccgtggcaggttgcctcagcgtgggaagtcccatgtacttccgttcaggtgctcaggaatttggagagccaggatggtggaaacttgttcataacaagcccccaacgatgaaacctgaaggagagaagttgtctgcctctactttgaaaataaaagcagcctcaaaaccaactttagatcccatcattactgttgagggacttagaaaacgagcaagtcggaatcctgtggaatctgccatggaattaaaagagaaaaggtctcgaactcaggaagcaaaagacattagaagagcccagaaggaggccgctggctttcttgacaggagcacatcttctacccctgtaaaattcataagccgaggccgcaggccagatgtgattctggaaaaaggcgaagtgattgacttttcctccttgagctcctctgaccgcaccccgctgacaagcccatctccttctccttctctggatttctctgcccctggtacacctgcctctcattctgccacacctagcttgctttcagaagcagatctgattccagatgtgatgcccccacaagccttgtttcatgatgacgatgagatggaaggcgatggagtcatagacccagggatggagtacgtcccaccccctgctgggtcagtagcttctgggccagtggttgggggcagaaagaaggtcagaggccctgaacagataaagcaggaggtagagagtgaggaggaaaaacccgacaggatggatattgacagtgaagacacagattcaaacacatctttgcaaacaagggctagagaaaagaggaagcctcagctggagaaggacacaaagccgaaagagcccaggtatactcccgtgagcatctacgaggaaaagctgctgctcaagaggctggaagcttgtcccggtgctgttgccatgactccggaagctcggagactgaaacgcaaactgattgtcagacaagcgaaaagggataggggattaccactttttgacttggatcaagttgttaatgctgctcttttgttagttgacgggatttatggagccaaagaaggaggaatttccagacttccagctggacaagccacgtacagaaccacctgtcaggacttcagaatccttgaccgataccagacttccttgccgtccaggaagggatttcgacaccagaccaccaagtttttgtatcgcttggtaggatcagaagatatggctgtggaccagagtattgtcagcccttatacctctcggatcttgaaaccttatatcaggcgtgattatgaaacaaagccacccaaactgcagctcctgtcacagattcgttcccacctgcacaggagcgaccctcactggacgccggagcccgacgcacctctcgattactgttatgtgcggccaaatcacatcccaacgatcaactccatgtgtcaggagtttttttggcctggcattgacctgtctgagtgtctgcagtacccagacttcagtgttgttgttctttataaaaaagtcatcattgcctttggcttcatggttcctgatgtgaaatacaatgaagcttacatttcatttctgttcgtccaccctgaatggagaagagcagggattgcaactttcatgatctatcatctgattcagacctgcatgggcaaggacgtaacccttcacgtctcagcaagcaaccccgctatgctactgtaccagaagtttggattcaagactgaagaatatgtattagatttctatgataaatattacccattggagagtacagagtgtaaacacgcattctttctgaggctccggcgctgatgcgaatacagctcacagagaaacgcatgtgctattggagaacaggtctttgtggagatctaaaggcagtgattgatttcacagggagctctaatctctgtgattacatggtccttcaaactcccaaccaaagtgagaaaagcggcatgcagtgaaatgagcagtgagcagccctttagcaaaatcgccctccagtccttcctggagatgccttcagccagcatcccagactccacagttatttatgaatgatgtcgtgattctccctccacctgacagtttgtaagagtgaaagagcatctaacctgatgctcttggagagagataacctgtctgtcataacttaaaggatgagaaaatgtggtgtagctattaaagattcatgcagtcccaaaaggcactgtcctgggatgatgagagattataaggtgatttcataaaaggaatccaaccctgtgcccggccattgatgtgttgtcattgaatccaggaggatttctagggcactgaagttttgttgtttcttttgctgactttggttacagtcagaaaaaataaactagatgtttgtgtctacatgttctacctgttgtacctattagcatcttcctgcagggacttgggcccatggcctgggaggttggtttgggattggggttgttgggcagcctgccattcacctggcctatcctggcccttctcatgcccaagacagttgtttcacaggagtggaagtgtgggtgatgcaagtagaaccctctagatgtaccctgtgtggtctgcaggactggactgtttgctgtgtttgtggatgttggcgatagactgtcaattaggttgtttgtgatccaacaagaacatttccaaaagtatctaggtgttctcaaataaaaagctttctttgcacaacccatggccagagcgtcaaaaaa

SEQ ID NO: 437201 - DNA, 4016 bp, Homo sapiens
ctctgcccgctcggttcctcagctcctcttcgtgtctttcccccgcggtggcgcggccctgcaccccacgcgtttgcggctgcggccggcggccgctctgctgggctccgggcgctgcagctcccggcgggcgtgtgcagcccgcagattcaggacgacccggctgcccggcttagcgcctttggagctccgcgctgaaggggccttgctccgcacaggcacggcacgcaagcttttggggtgcccagtggctctgttttcaagtcacagccggcccgcaggaggcttcgtgacggagttatcagagacattgagaggcaaattcggaaaaaagaaaacattcgtcttttgggagaacagattattttgactgagcaacttgaagcagaaagagagaagatgttattggcaaaaggatctcaaaaatcatgacttgaatgtgaaatatctgttggacagacaacacgagtttgtgtgtgtgtgttgatggagagtagcttagtagtatcttcatctttttttttggtcactgtccttttaaacttgatcaaataaaggacagtgggtcatataagttactgctttcagggtcccttatatctgaataaaggagtgtgggcagacactttttggaagagtctgtctgggtgatcctggtagaagccccattagggtcactgtccagtgcttagggttgttactgagaagcactgccgagcttgtgagaaggaagggatggatagtagcatccacctgagtagtctgatcagtcggcatgatgacgaagccacgagaacatcgacctcagaaggactggaggaaggtgaagtggagggagagacgctcctgatcgtcgaatccgaggatcaggcatcagtggacttatcgcacgaccagagtggggattccctcaacagtgatgaaggagacgtgtcttggatggaggagcagctgtcctacttctgtgacaagtgccaaaaatggataccagccagtcagctgagggaacagctcagttaccttaagggtgataatttttttaggtttacttgttcggattgctcagcagatggcaaggagcagtatgaaaggctgaagctgacatggcagcaagtcgtcatgttggcaatgtacaacttgtctctggaaggaagtggacgtcaaggttatttcaggtggaaagaagatatctgtgcttttattgagaaacattggacttttttactagggaataggaaaaagacgtctacctggtggagcaccgtggcaggttgcctcagcgtgggaagtcccatgtacttccgttcaggtgctcaggaatttggagagccaggatggtggaaacttgttcataacaagcccccaacgatgaaacctgaaggagagaagttgtctgcctctactttgaaaataaaagcagcctcaaaaccaactttagatcccatcattactgttgagggacttagaaaacgagcaagtcggaatcctgtggaatctgccatggaattaaaagagaaaaggtctcgaactcaggaagcaaaagacattagaagagcccagaaggaggccgctggctttcttgacaggagcacatcttctacccctgtaaaattcataagccgaggccgcaggccagatgtgattctggaaaaaggcgaagtgattgacttttcctccttgagctcctctgaccgcaccccgctgacaagcccatctccttctccttctctggatttctctgcccctggtacacctgcctctcattctgccacacctagcttgctttcagaagcagatctgattccagatgtgatgcccccacaagccttgtttcatgatgacgatgagatggaaggcgatggagtcatagacccagggatggagtacgtcccaccccctgctgggtcagtagcttctgggccagtggttgggggcagaaagaaggtcagaggccctgaacagataaagcaggaggtagagagtgaggaggaaaaacccgacaggatggatattgacagtgaagacacagattcaaacacatctttgcaaacaagggctagagaaaagaggaagcctcagctggagaaggacacaaagccgaaagagcccaggtatactcccgtgagcatctacgaggaaaagctgctgctcaagaggctggaagcttgtcccggtgctgttgccatgactccggaagctcggagactgaaacgcaaactgattgtcagacaagcgaaaagggataggggattaccactttttgacttggatcaagttgttaatgctgctcttttgttagttgacgggatttatggagccaaagaaggaggaatttccagacttccagctggacaagccacgtacagaaccacctgtcaggacttcagaatccttgaccgataccagacttccttgccgtccaggaagggatttcgacaccagaccaccaagtttttgtatcgcttggtaggatcagaagatatggctgtggaccagagtattgtcagcccttatacctctcggatcttgaaaccttatatcaggcgtgattatgaaacaaagccacccaaactgcagctcctgtcacagattcgttcccacctgcacaggagcgaccctcactggacgccggagcccgacgcacctctcgattactgttatgtgcggccaaatcacatcccaacgatcaactccatgtgtcaggagtttttttggcctggcattgacctgtctgagtgtctgcagtacccagacttcagtgttgttgttctttataaaaaagtcatcattgcctttggcttcatggttcctgatgtgaaatacaatgaagcttacatttcatttctgttcgtccaccctgaatggagaagagcagggattgcaactttcatgatctatcatctgattcagacctgcatgggcaaggacgtaacccttcacgtctcagcaagcaaccccgctatgctactgtaccagaagtttggattcaagactgaagaatatgtattagatttctatgataaatattacccattggagagtacagagtgtaaacacgcattctttctgaggctccggcgctgatgcgaatacagctcacagagaaacgcatgtgctattggagaacaggtctttgtggagatctaaaggcagtgattgatttcacagggagctctaatctctgtgattacatggtccttcaaactcccaaccaaagtgagaaaagcggcatgcagtgaaatgagcagtgagcagccctttagcaaaatcgccctccagtccttcctggagatgccttcagccagcatcccagactccacagttatttatgaatgatgtcgtgattctccctccacctgacagtttgtaagagtgaaagagcatctaacctgatgctcttggagagagataacctgtctgtcataacttaaaggatgagaaaatgtggtgtagctattaaagattcatgcagtcccaaaaggcactgtcctgggatgatgagagattataaggtgatttcataaaaggaatccaaccctgtgcccggccattgatgtgttgtcattgaatccaggaggatttctagggcactgaagttttgttgtttcttttgctgactttggttacagtcagaaaaaataaactagatgtttgtgtctacatgttctacctgttgtacctattagcatcttcctgcagggacttgggcccatggcctgggaggttggtttgggattggggttgttgggcagcctgccattcacctggcctatcctggcccttctcatgcccaagacagttgtttcacaggagtggaagtgtgggtgatgcaagtagaaccctctagatgtaccctgtgtggtctgcaggactggactgtttgctgtgtttgtggatgttggcgatagactgtcaattaggttgtttgtgatccaacaagaacatttccaaaagtatctaggtgttctcaaataaaaagctttctttgcacaacccatggccagagcgtcaaaaaa

SEQ ID NO: 437202 - DNA, 3952 bp, Homo sapiens
ctctgcccgctcggttcctcagctcctcttcgtgtctttcccccgcggtggcgcggccctgcaccccacgcgtttgcggctgcggccggcggccgctctgctgggctccgggcgctgcagctcccggcgggcgtgtgcagcccgcagattcaggacgacccggctgcccggcttagcgcctttggagctccgcgctgaaggggccttgctccgcacagaggcttcgtgacggagttatcagagacattgagaggcaaattcggaaaaaagaaaacattcgtcttttgggagaacagattattttgactgagcaacttgaagcagaaagagagaagatgttattggcaaaaggatctcaaaaatcatgacttgaatgtgaaatatctgttggacagacaacacgagtttgtgtgtgtgtgttgatggagagtagcttagtagtatcttcatctttttttttggtcactgtccttttaaacttgatcaaataaaggacagtgggtcatataagttactgctttcagggtcccttatatctgaataaaggagtgtgggcagacactttttggaagagtctgtctgggtgatcctggtagaagccccattagggtcactgtccagtgcttagggttgttactgagaagcactgccgagcttgtgagaaggaagggatggatagtagcatccacctgagtagtctgatcagtcggcatgatgacgaagccacgagaacatcgacctcagaaggactggaggaaggtgaagtggagggagagacgctcctgatcgtcgaatccgaggatcaggcatcagtggacttatcgcacgaccagagtggggattccctcaacagtgatgaaggagacgtgtcttggatggaggagcagctgtcctacttctgtgacaagtgccaaaaatggataccagccagtcagctgagggaacagctcagttaccttaagggtgataatttttttaggtttacttgttcggattgctcagcagatggcaaggagcagtatgaaaggctgaagctgacatggcagcaagtcgtcatgttggcaatgtacaacttgtctctggaaggaagtggacgtcaaggttatttcaggtggaaagaagatatctgtgcttttattgagaaacattggacttttttactagggaataggaaaaagacgtctacctggtggagcaccgtggcaggttgcctcagcgtgggaagtcccatgtacttccgttcaggtgctcaggaatttggagagccaggatggtggaaacttgttcataacaagcccccaacgatgaaacctgaaggagagaagttgtctgcctctactttgaaaataaaagcagcctcaaaaccaactttagatcccatcattactgttgagggacttagaaaacgagcaagtcggaatcctgtggaatctgccatggaattaaaagagaaaaggtctcgaactcaggaagcaaaagacattagaagagcccagaaggaggccgctggctttcttgacaggagcacatcttctacccctgtaaaattcataagccgaggccgcaggccagatgtgattctggaaaaaggcgaagtgattgacttttcctccttgagctcctctgaccgcaccccgctgacaagcccatctccttctccttctctggatttctctgcccctggtacacctgcctctcattctgccacacctagcttgctttcagaagcagatctgattccagatgtgatgcccccacaagccttgtttcatgatgacgatgagatggaaggcgatggagtcatagacccagggatggagtacgtcccaccccctgctgggtcagtagcttctgggccagtggttgggggcagaaagaaggtcagaggccctgaacagataaagcaggaggtagagagtgaggaggaaaaacccgacaggatggatattgacagtgaagacacagattcaaacacatctttgcaaacaagggctagagaaaagaggaagcctcagctggagaaggacacaaagccgaaagagcccaggtatactcccgtgagcatctacgaggaaaagctgctgctcaagaggctggaagcttgtcccggtgctgttgccatgactccggaagctcggagactgaaacgcaaactgattgtcagacaagcgaaaagggataggggattaccactttttgacttggatcaagttgttaatgctgctcttttgttagttgacgggatttatggagccaaagaaggaggaatttccagacttccagctggacaagccacgtacagaaccacctgtcaggacttcagaatccttgaccgataccagacttccttgccgtccaggaagggatttcgacaccagaccaccaagtttttgtatcgcttggtaggatcagaagatatggctgtggaccagagtattgtcagcccttatacctctcggatcttgaaaccttatatcaggcgtgattatgaaacaaagccacccaaactgcagctcctgtcacagattcgttcccacctgcacaggagcgaccctcactggacgccggagcccgacgcacctctcgattactgttatgtgcggccaaatcacatcccaacgatcaactccatgtgtcaggagtttttttggcctggcattgacctgtctgagtgtctgcagtacccagacttcagtgttgttgttctttataaaaaagtcatcattgcctttggcttcatggttcctgatgtgaaatacaatgaagcttacatttcatttctgttcgtccaccctgaatggagaagagcagggattgcaactttcatgatctatcatctgattcagacctgcatgggcaaggacgtaacccttcacgtctcagcaagcaaccccgctatgctactgtaccagaagtttggattcaagactgaagaatatgtattagatttctatgataaatattacccattggagagtacagagtgtaaacacgcattctttctgaggctccggcgctgatgcgaatacagctcacagagaaacgcatgtgctattggagaacaggtctttgtggagatctaaaggcagtgattgatttcacagggagctctaatctctgtgattacatggtccttcaaactcccaaccaaagtgagaaaagcggcatgcagtgaaatgagcagtgagcagccctttagcaaaatcgccctccagtccttcctggagatgccttcagccagcatcccagactccacagttatttatgaatgatgtcgtgattctccctccacctgacagtttgtaagagtgaaagagcatctaacctgatgctcttggagagagataacctgtctgtcataacttaaaggatgagaaaatgtggtgtagctattaaagattcatgcagtcccaaaaggcactgtcctgggatgatgagagattataaggtgatttcataaaaggaatccaaccctgtgcccggccattgatgtgttgtcattgaatccaggaggatttctagggcactgaagttttgttgtttcttttgctgactttggttacagtcagaaaaaataaactagatgtttgtgtctacatgttctacctgttgtacctattagcatcttcctgcagggacttgggcccatggcctgggaggttggtttgggattggggttgttgggcagcctgccattcacctggcctatcctggcccttctcatgcccaagacagttgtttcacaggagtggaagtgtgggtgatgcaagtagaaccctctagatgtaccctgtgtggtctgcaggactggactgtttgctgtgtttgtggatgttggcgatagactgtcaattaggttgtttgtgatccaacaagaacatttccaaaagtatctaggtgttctcaaataaaaagctttctttgcacaacccatggccagagcgtcaaaaaa

SEQ ID NO: 437203 - DNA, 1509 bp, Homo sapiens
aacgcccgcctgcaaggtcctctgcgccctggcagccaggagtcgccgccacgaccgccgggtctcagtgggtgcctgcgccttctccccgcccgcctgccccgggccatccagaaacttgctctacccgccgcgggtgctcggcagtgctgcccatggcccagcccaggagcctatttagggcgccggacgggctggacagaggcgcggctcagtaattgaaggcctgaaacgcccatgtgccactgactaggaggcttccctgctgcggcacttcatgacccagcggcgcgcggcccagtgaagccaccgtggtgtccagcatggccgcgctgctcctgggcgcggtgctgctggtggcccagccccagctagtgccttcccgccccgccgagctaggccagcaggagcttctgcggaaagcggggaccctccaggatgacgtccgcgatggcgtggccccaaacggctctgcccagcagttgccgcagaccatcatcatcggcgtgcgcaagggcggcacgcgcgcactgctggagatgctcagcctgcaccccgacgtggcggccgcggagaacgaggtccacttcttcgactgggaggagcattacagccacggcttgggctggtacctcagccagatgcccttctcctggccacaccagctcacagtggagaagacccccgcgtatttcacgtcgcccaaagtgcctgagcgagtctacagcatgaacccgtccatccggctgctgctcatcctgcgagacccgtcggagcgcgtgctatctgactacacccaagtgttctacaaccacatgcagaagcacaagccctacccgtccatcgaggagttcctggtgcgcgatggcaggctcaatgtggactacaaggccctcaaccgcagcctctaccacgtgcacatgcagaactggctgcgctttttcccgctgcgccacatccacattgtggacggcgaccgcctcatcagggaccccttccctgagatccaaaaggtcgagaggttcctaaagctgtcgccgcagatcaatgcttcgaacttctactttaacaaaaccaagggcttttactgcctgcgggacagcggccgggaccgctgcttacatgagtccaaaggccgggcgcacccccaagtcgatcccaaactactcaataaactgcacgaatattttcatgagccaaataagaagttcttcgagcttgttggcagaacatttgactggcactgatttgcaataagctaagctcagaaactttcctactgtaagttctggtgtacatctgaggggaaaaagaattttaaaaaagcatttaaggtataatttatttgtaaaatccataaagtacttctgtacagtattagattcacaattgccatatatactagttatatttttctacttgttaaatggagggcattttgtattgtttttcatggttgttaacattgtgtaatatgtctctatatgaaggaactaaactatttcactg

SEQ ID NO: 437204 - DNA, 2368 bp, Homo sapiens
aacgcccgcctgcaaggtcctctgcgccctggcagccaggagtcgccgccacgaccgccgggtctcagtgggtgcctgcgccttctccccgcccgcctgccccgggccatccagaaacttgctctacccgccgcgggtgctcggcagtgctgcccatggcccagcccaggagcctatttagggcgccggacgggctggacagaggcgcggctcagtaattgaaggcctgaaacgcccatgtgccactgactaggaggcttccctgctgcggcacttcatgacccagcggcgcgcggcccagtgaagccaccgtggtgtccagcatggccgcgctgctcctgggcgcggtgctgctggtggcccagccccagctagtgccttcccgccccgccgagctaggccagcaggagcttctgcggaaagcggggaccctccaggatgacgtccgcgatggcgtggccccaaacggctctgcccagcagttgccgcagaccatcatcatcggcgtgcgcaagggcggcacgcgcgcactgctggagatgctcagcctgcaccccgacgtggcggccgcggagaacgaggtccacttcttcgactgggaggagcattacagccacggcttgggctggtacctcagccagatgcccttctcctggccacaccagctcacagtggagaagacccccgcgtatttcacgtcgcccaaagtgcctgagcgagtctacagcatgaacccgtccatccggctgctgctcatcctgcgagacccgtcggagcgcgtgctatctgactacacccaagtgttctacaaccacatgcagaagcacaagccctacccgtccatcgaggagttcctggtgcgcgatggcaggctcaatgtggactacaaggccctcaaccgcagcctctaccacgtgcacatgcagaactggctgcgctttttcccgctgcgccacatccacattgtggacggcgaccgcctcatcagggaccccttccctgagatccaaaaggtcgagaggttcctaaagctgtcgccgcagatcaatgcttcgaacttctactttaacaaaaccaagggcttttactgcctgcgggacagcggccgggaccgctgcttacatgagtccaaaggccgggcgcacccccaagtcgatcccaaactactcaataaactgcacgaatattttcatgagccaaataagaagttcttcgagcttgttggcagaacatttgactggcactgatttgcaataagctaagctcagaaactttcctactgtaagttctggtgtacatctgaggggaaaaagaattttaaaaaagcatttaaggtataatttatttgtaaaatccataaagtacttctgtacagtattagattcacaattgccatatatactagttatatttttctacttgttaaatggagggcattttgtattgtttttcatggttgttaacattgtgtaatatgtctctatatgaaggaactaaactatttcactgaaaaaaaaaaaaagattttttctggagacgctatgtttttttgaatataattaacttgcccccaactcaaaatagctgtctgtgttgcaatcattgcaaaatctaaattcttttgttacttaaaaaaacatgtttttcatggctattacaatcctctctctcccctctcctttctgcattgctctttttaatttttaatgtctcattgtgatcatcagatttatttttacttggattgtaagatttatctcctcggcgattccttgtcatttttggaggtcacagttttactcattcccatgtgtaaacttcaagtaaacaaagcaatattcaggatggagaagcagttagtgactggctagaggtctcttgggatccatcttgacctcaaagaatatttgcacatgcttctgatctcagcagttataataaagaggattaaacccttggccttcagaatgatcttggacctggatactttgccccaggtggcagctggcctccagaaagccaattagaatagaaaagagaaactgcgaaatctatgcgtgtcttcatcctgtcggttctgtgaaaggctgactaaaagggtagtagtcttttgcttagtctgaaagtctgcttacttcctgaaagacacattggcattatagacatatattccatatgcactgagacataaatatgtgtatgtttcaaaatcaactctaaatttggagtcctgaatgtgaaagaaaaagtaagttcccaagtgttgaagttaaaaagagaaaagggcagagttgaaggtagcacctaagagaaccactgtacctgcccccagaggagtggctggagttcagttttacttctgcccctg

SEQ ID NO: 437205 - DNA, 2293 bp, Homo sapiens
gacagggcgctctttgaagccggctcctcacgcggattctggcccaggccgccgctccggtcccagtccggctgcagagcgaattggagaggatggcacctcctgcttcccggggggcggaaggagcgccagcgcctaagtaattgaaggcctgaaacgcccatgtgccactgactaggaggcttccctgctgcggcacttcatgacccagcggcgcgcggcccagtgaagccaccgtggtgtccagcatggccgcgctgctcctgggcgcggtgctgctggtggcccagccccagctagtgccttcccgccccgccgagctaggccagcaggagcttctgcggaaagcggggaccctccaggatgacgtccgcgatggcgtggccccaaacggctctgcccagcagttgccgcagaccatcatcatcggcgtgcgcaagggcggcacgcgcgcactgctggagatgctcagcctgcaccccgacgtggcggccgcggagaacgaggtccacttcttcgactgggaggagcattacagccacggcttgggctggtacctcagccagatgcccttctcctggccacaccagctcacagtggagaagacccccgcgtatttcacgtcgcccaaagtgcctgagcgagtctacagcatgaacccgtccatccggctgctgctcatcctgcgagacccgtcggagcgcgtgctatctgactacacccaagtgttctacaaccacatgcagaagcacaagccctacccgtccatcgaggagttcctggtgcgcgatggcaggctcaatgtggactacaaggccctcaaccgcagcctctaccacgtgcacatgcagaactggctgcgctttttcccgctgcgccacatccacattgtggacggcgaccgcctcatcagggaccccttccctgagatccaaaaggtcgagaggttcctaaagctgtcgccgcagatcaatgcttcgaacttctactttaacaaaaccaagggcttttactgcctgcgggacagcggccgggaccgctgcttacatgagtccaaaggccgggcgcacccccaagtcgatcccaaactactcaataaactgcacgaatattttcatgagccaaataagaagttcttcgagcttgttggcagaacatttgactggcactgatttgcaataagctaagctcagaaactttcctactgtaagttctggtgtacatctgaggggaaaaagaattttaaaaaagcatttaaggtataatttatttgtaaaatccataaagtacttctgtacagtattagattcacaattgccatatatactagttatatttttctacttgttaaatggagggcattttgtattgtttttcatggttgttaacattgtgtaatatgtctctatatgaaggaactaaactatttcactgaaaaaaaaaaaaagattttttctggagacgctatgtttttttgaatataattaacttgcccccaactcaaaatagctgtctgtgttgcaatcattgcaaaatctaaattcttttgttacttaaaaaaacatgtttttcatggctattacaatcctctctctcccctctcctttctgcattgctctttttaatttttaatgtctcattgtgatcatcagatttatttttacttggattgtaagatttatctcctcggcgattccttgtcatttttggaggtcacagttttactcattcccatgtgtaaacttcaagtaaacaaagcaatattcaggatggagaagcagttagtgactggctagaggtctcttgggatccatcttgacctcaaagaatatttgcacatgcttctgatctcagcagttataataaagaggattaaacccttggccttcagaatgatcttggacctggatactttgccccaggtggcagctggcctccagaaagccaattagaatagaaaagagaaactgcgaaatctatgcgtgtcttcatcctgtcggttctgtgaaaggctgactaaaagggtagtagtcttttgcttagtctgaaagtctgcttacttcctgaaagacacattggcattatagacatatattccatatgcactgagacataaatatgtgtatgtttcaaaatcaactctaaatttggagtcctgaatgtgaaagaaaaagtaagttcccaagtgttgaagttaaaaagagaaaagggcagagttgaaggtagcacctaagagaaccactgtacctgcccccagaggagtggctggagttcagttttacttctgcccctg

SEQ ID NO: 437206 - DNA, 2288 bp, Homo sapiens
ctaagaagaatcgaggctggagcaggtggagtggatgcagagggaaccaggaagcaaaggctggggattttcccatcctcctcacctcctgccctagcacctctgctctggaagtcccgagggaccggttgatcttaattgaaggcctgaaacgcccatgtgccactgactaggaggcttccctgctgcggcacttcatgacccagcggcgcgcggcccagtgaagccaccgtggtgtccagcatggccgcgctgctcctgggcgcggtgctgctggtggcccagccccagctagtgccttcccgccccgccgagctaggccagcaggagcttctgcggaaagcggggaccctccaggatgacgtccgcgatggcgtggccccaaacggctctgcccagcagttgccgcagaccatcatcatcggcgtgcgcaagggcggcacgcgcgcactgctggagatgctcagcctgcaccccgacgtggcggccgcggagaacgaggtccacttcttcgactgggaggagcattacagccacggcttgggctggtacctcagccagatgcccttctcctggccacaccagctcacagtggagaagacccccgcgtatttcacgtcgcccaaagtgcctgagcgagtctacagcatgaacccgtccatccggctgctgctcatcctgcgagacccgtcggagcgcgtgctatctgactacacccaagtgttctacaaccacatgcagaagcacaagccctacccgtccatcgaggagttcctggtgcgcgatggcaggctcaatgtggactacaaggccctcaaccgcagcctctaccacgtgcacatgcagaactggctgcgctttttcccgctgcgccacatccacattgtggacggcgaccgcctcatcagggaccccttccctgagatccaaaaggtcgagaggttcctaaagctgtcgccgcagatcaatgcttcgaacttctactttaacaaaaccaagggcttttactgcctgcgggacagcggccgggaccgctgcttacatgagtccaaaggccgggcgcacccccaagtcgatcccaaactactcaataaactgcacgaatattttcatgagccaaataagaagttcttcgagcttgttggcagaacatttgactggcactgatttgcaataagctaagctcagaaactttcctactgtaagttctggtgtacatctgaggggaaaaagaattttaaaaaagcatttaaggtataatttatttgtaaaatccataaagtacttctgtacagtattagattcacaattgccatatatactagttatatttttctacttgttaaatggagggcattttgtattgtttttcatggttgttaacattgtgtaatatgtctctatatgaaggaactaaactatttcactgaaaaaaaaaaaaagattttttctggagacgctatgtttttttgaatataattaacttgcccccaactcaaaatagctgtctgtgttgcaatcattgcaaaatctaaattcttttgttacttaaaaaaacatgtttttcatggctattacaatcctctctctcccctctcctttctgcattgctctttttaatttttaatgtctcattgtgatcatcagatttatttttacttggattgtaagatttatctcctcggcgattccttgtcatttttggaggtcacagttttactcattcccatgtgtaaacttcaagtaaacaaagcaatattcaggatggagaagcagttagtgactggctagaggtctcttgggatccatcttgacctcaaagaatatttgcacatgcttctgatctcagcagttataataaagaggattaaacccttggccttcagaatgatcttggacctggatactttgccccaggtggcagctggcctccagaaagccaattagaatagaaaagagaaactgcgaaatctatgcgtgtcttcatcctgtcggttctgtgaaaggctgactaaaagggtagtagtcttttgcttagtctgaaagtctgcttacttcctgaaagacacattggcattatagacatatattccatatgcactgagacataaatatgtgtatgtttcaaaatcaactctaaatttggagtcctgaatgtgaaagaaaaagtaagttcccaagtgttgaagttaaaaagagaaaagggcagagttgaaggtagcacctaagagaaccactgtacctgcccccagaggagtggctggagttcagttttacttctgcccctg

SEQ ID NO: 437207 - DNA, 379 bp, Homo sapiens
ggtttaaacaatagatatttatttctcacagctctggaggctggaagttcaagatcaaggtgtcagcagaagtggttcttcatgaaaccccattccttgctcgcagagggccacattttgcctgtgccttcacatggtggagagaatgagagagagagacagagtgagctctgttttatcttcctcttcttataaggacaccaatcttgtcagaatggagccccacccttacaaccttatggaaatccgatcatctaaagcccccacctccaaataccatcacactgagggttagggtctcaacctatgaatttggggaggacaaaaacattcagtccataacaacctggctcaagaaatgagacaaatcatctctccc

SEQ ID NO: 437208 - DNA, 1454 bp, Homo sapiens
aacgcccgcctgcaaggtcctctgcgccctggcagccaggagtcgccgccacgaccgccgggtctcagtgggtgcctgcgccttctccccgcccgcctgccccgggccatccagaaacttgctctacccgccgcgggtgctcggcagtgctgcccatggcccagcccaggagcctatttagggcgccggacgggctggacagaggcgcggctcagtaattgaaggcctgaaacgcccatgtgccactgactaggaggcttccctgctgcggcacttcatgacccagcggcgcgcggcccagtgaagccaccgtggtgtccagcatggccgcgctgctcctgggcgcggtgctgctggtggcccagccccagctagtgccttcccgccccgccgagctaggccagcaggagcttctgcggaaagcggggaccctccaggatgacgtccgcgatggcgtggccccaaacggctctgcccagcagttgccgcagaccatcatcatcggcgtgcgcaagggcggcacgcgcgcactgctggagatgctcagcctgcaccccgacgtggcggccgcggagaacgaggtccacttcttcgactgggaggagcattacagccacggcttgggctggtacctcagccagatgcccttctcctggccacaccagctcacagtggagaagacccccgcgtatttcacgtcgcccaaagtgcctgagcgagtctacagcatgaacccgtccatccggctgctgctcatcctgcgagacccgtcggagcgcgtgctatctgactacacccaagtgttctacaaccacatgcagaagcacaagccctacccgtccatcgaggagttcctggtgcgcgatggcaggctcaatgtggactacaaggccctcaaccgcagcctctaccacgtgcacatgcagaactggctgcgctttttcccgctgcgccacatccacattgtggacggcgaccgcctcatcagggaccccttccctgagatccaaaaggtcgagaggttcctaaagctgtcgccgcagatcaatgcttcgaacttctactttaacaaaaccaagggcttttactgcctgcgggacagcggccgggaccgctgcttacatgagtccaaaggccgggcgcacccccaagtcgatcccaaactactcaataaactgcacgaatattttcatgagccaaataagaagttcttcgagcttgttggcagaacatttgactggcactgatttgcaataagctaagctcagaaactttcctactgtaagttctggtgtacatctgaggggaaaaagaattttaaaaaagcatttaaggtataatttattttagttatatttttctacttgttaaatggagggcattttgtattgtttttcatggttgttaacattgtgtaatatgtctctatatgaaggaactaaactatttcactg

SEQ ID NO: 437209 - DNA, 2736 bp, Homo sapiens
ggaagaagaagctggagccaaagccgggtgccggcgcgggatggggtgtgctgggctctgcagttatagaaggcaggagagtgctagctggatttaaagccaacttcttgccccatgaccttgggcaacaatttctccctccctgaccctaaatttcttcctctgcaaaacagtgatgaaaagattattataagaaagtgagaaaatgtatatgaaatgcatcttgccgattggagaacacttgtgcaattgtaaagggtgttgttccaaacgtgtctccagaacctaactcagtgcctgcctggcacttagacattcaataagtatatttggaataattgaatgagtgattggactgaatcttcacagcaaccttggagagcagatggcgtcatttctattttaaggatttggaatctgccgatcggaaaacttaattaattttctaaagctctggaggctggaagttcaagatcaaggtgtcagcagaagtggttcttcatgaaaccccattccttgctcgcagagggccacattttgcctgtgccttcacatggtggagagaatgagagagagagacagataattgaaggcctgaaacgcccatgtgccactgactaggaggcttccctgctgcggcacttcatgacccagcggcgcgcggcccagtgaagccaccgtggtgtccagcatggccgcgctgctcctgggcgcggtgctgctggtggcccagccccagctagtgccttcccgccccgccgagctaggccagcaggagcttctgcggaaagcggggaccctccaggatgacgtccgcgatggcgtggccccaaacggctctgcccagcagttgccgcagaccatcatcatcggcgtgcgcaagggcggcacgcgcgcactgctggagatgctcagcctgcaccccgacgtggcggccgcggagaacgaggtccacttcttcgactgggaggagcattacagccacggcttgggctggtacctcagccagatgcccttctcctggccacaccagctcacagtggagaagacccccgcgtatttcacgtcgcccaaagtgcctgagcgagtctacagcatgaacccgtccatccggctgctgctcatcctgcgagacccgtcggagcgcgtgctatctgactacacccaagtgttctacaaccacatgcagaagcacaagccctacccgtccatcgaggagttcctggtgcgcgatggcaggctcaatgtggactacaaggccctcaaccgcagcctctaccacgtgcacatgcagaactggctgcgctttttcccgctgcgccacatccacattgtggacggcgaccgcctcatcagggaccccttccctgagatccaaaaggtcgagaggttcctaaagctgtcgccgcagatcaatgcttcgaacttctactttaacaaaaccaagggcttttactgcctgcgggacagcggccgggaccgctgcttacatgagtccaaaggccgggcgcacccccaagtcgatcccaaactactcaataaactgcacgaatattttcatgagccaaataagaagttcttcgagcttgttggcagaacatttgactggcactgatttgcaataagctaagctcagaaactttcctactgtaagttctggtgtacatctgaggggaaaaagaattttaaaaaagcatttaaggtataatttatttgtaaaatccataaagtacttctgtacagtattagattcacaattgccatatatactagttatatttttctacttgttaaatggagggcattttgtattgtttttcatggttgttaacattgtgtaatatgtctctatatgaaggaactaaactatttcactgaaaaaaaaaaaaagattttttctggagacgctatgtttttttgaatataattaacttgcccccaactcaaaatagctgtctgtgttgcaatcattgcaaaatctaaattcttttgttacttaaaaaaacatgtttttcatggctattacaatcctctctctcccctctcctttctgcattgctctttttaatttttaatgtctcattgtgatcatcagatttatttttacttggattgtaagatttatctcctcggcgattccttgtcatttttggaggtcacagttttactcattcccatgtgtaaacttcaagtaaacaaagcaatattcaggatggagaagcagttagtgactggctagaggtctcttgggatccatcttgacctcaaagaatatttgcacatgcttctgatctcagcagttataataaagaggattaaacccttggccttcagaatgatcttggacctggatactttgccccaggtggcagctggcctccagaaagccaattagaatagaaaagagaaactgcgaaatctatgcgtgtcttcatcctgtcggttctgtgaaaggctgactaaaagggtagtagtcttttgcttagtctgaaagtctgcttacttcctgaaagacacattggcattatagacatatattccatatgcactgagacataaatatgtgtatgtttcaaaatcaactctaaatttggagtcctgaatgtgaaagaaaaagtaagttcccaagtgttgaagttaaaaagagaaaagggcagagttgaaggtagcacctaagagaaccactgtacctgcccccagaggagtggctggagttcagttttacttctgcccctg

SEQ ID NO: 437210 - DNA, 2161 bp, Homo sapiens
aggggccaccgcaccgggtgggcgggaccgactactacccgaccagccgctggagctgctgcggcacttcatgacccagcggcgcgcggcccagtgaagccaccgtggtgtccagcatggccgcgctgctcctgggcgcggtgctgctggtggcccagccccagctagtgccttcccgccccgccgagctaggccagcaggagcttctgcggaaagcggggaccctccaggatgacgtccgcgatggcgtggccccaaacggctctgcccagcagttgccgcagaccatcatcatcggcgtgcgcaagggcggcacgcgcgcactgctggagatgctcagcctgcaccccgacgtggcggccgcggagaacgaggtccacttcttcgactgggaggagcattacagccacggcttgggctggtacctcagccagatgcccttctcctggccacaccagctcacagtggagaagacccccgcgtatttcacgtcgcccaaagtgcctgagcgagtctacagcatgaacccgtccatccggctgctgctcatcctgcgagacccgtcggagcgcgtgctatctgactacacccaagtgttctacaaccacatgcagaagcacaagccctacccgtccatcgaggagttcctggtgcgcgatggcaggctcaatgtggactacaaggccctcaaccgcagcctctaccacgtgcacatgcagaactggctgcgctttttcccgctgcgccacatccacattgtggacggcgaccgcctcatcagggaccccttccctgagatccaaaaggtcgagaggttcctaaagctgtcgccgcagatcaatgcttcgaacttctactttaacaaaaccaagggcttttactgcctgcgggacagcggccgggaccgctgcttacatgagtccaaaggccgggcgcacccccaagtcgatcccaaactactcaataaactgcacgaatattttcatgagccaaataagaagttcttcgagcttgttggcagaacatttgactggcactgatttgcaataagctaagctcagaaactttcctactgtaagttctggtgtacatctgaggggaaaaagaattttaaaaaagcatttaaggtataatttatttgtaaaatccataaagtacttctgtacagtattagattcacaattgccatatatactagttatatttttctacttgttaaatggagggcattttgtattgtttttcatggttgttaacattgtgtaatatgtctctatatgaaggaactaaactatttcactgaaaaaaaaaaaaagattttttctggagacgctatgtttttttgaatataattaacttgcccccaactcaaaatagctgtctgtgttgcaatcattgcaaaatctaaattcttttgttacttaaaaaaacatgtttttcatggctattacaatcctctctctcccctctcctttctgcattgctctttttaatttttaatgtctcattgtgatcatcagatttatttttacttggattgtaagatttatctcctcggcgattccttgtcatttttggaggtcacagttttactcattcccatgtgtaaacttcaagtaaacaaagcaatattcaggatggagaagcagttagtgactggctagaggtctcttgggatccatcttgacctcaaagaatatttgcacatgcttctgatctcagcagttataataaagaggattaaacccttggccttcagaatgatcttggacctggatactttgccccaggtggcagctggcctccagaaagccaattagaatagaaaagagaaactgcgaaatctatgcgtgtcttcatcctgtcggttctgtgaaaggctgactaaaagggtagtagtcttttgcttagtctgaaagtctgcttacttcctgaaagacacattggcattatagacatatattccatatgcactgagacataaatatgtgtatgtttcaaaatcaactctaaatttggagtcctgaatgtgaaagaaaaagtaagttcccaagtgttgaagttaaaaagagaaaagggcagagttgaaggtagcacctaagagaaccactgtacctgcccccagaggagtggctggagttcagttttacttctgcccctg

SEQ ID NO: 437211 - DNA, 3254 bp, Homo sapiens
cacgtcatctactctgtgaaatttttcatttcatatgcaattcccgatgtatcaaaacgcacaaagagcaagatccagagagaaaaatacctaacccaaaagcttcttcatgagaatcacctcaaagatatgacgaaaaatatgggggtgatagctgagcggatgatagaagcagtagataacaatttacggccaaaatcagaataagagctttatgttctgagaagcactttaaggaatttagctttgtcaaaatatattaggaatcactaatgagaatgtgtaagttaaatcactttggcaaatatgagtctcaactattgccatttcctcatgtattatttttcagtttcagctagcgatgcagaaactggaaaatgtaaaacttagatcatgaagggcataaaacttatcacccggaaaacctcaatgttacctttttctgataaattggaattttacagaaaaagtccctcagtgtgcttaaaaaccaccccttctaaagtagaatggattcttttttttctgtttgattattttcatttctgtctattctcaggcgcatgatctcctttatttttaagccatgtttcatttcttcacttggctagatctgttccagggtcatcttttccttacagtaccatcattatagatttaatttaatagctttcatgtgattaaaaatagctaactagactcaaggattcacaatatttaggtgtattttcaatacctccagaaaggaaacctcagttaatcagaggaaatagtttcagtcttcatttgagcatgtctttccatctcaaaaaaatactcttagtaggttggagtgaagatagcaaggttttgaagcatatttgtcctaatccacagtgacactttttatcttccaggagcactcctaggaggttccgtgcctaatcaatgttgactgctttgcagatctcaagggaataaaatgacaaaagcagggaaagttacagattcaaacagcattttaactcatgttgatctggataattaatcttttctaaagatgtgtagtttcttggaaaacagtgatatcacatgattaaaattacatttttatcaacataattgtctggaaaagataagcccctcaattttctaccagttgacttttattcattagatacagaaggtgcagtattacacatcaccagctgcctttgtgaatggctcactacacagccattggggtacaactgtgtgcatgggcagaaacagcaagtgccctcattgtggtcattgggtggggagtgccttttgtcaaggagtctgcaggaattggcttatttctgtatgccaaagtgatcaacacaccaaagtctctgccataaagaatgtggcttccttgcatcctccatcctgttactctgggcccagtaatttgatgtaactgtctgattgtactagagacaggagtatacccagcttattcataatcaagtaaagagactcagattagatttgattttttagcctcctctagagccaatcaggcagttaagagtaataaaggaaaagggtttggtcacaaaccctaccattatctggagattacttcctgctgcactcctgtcttgccatgcacgtcttgccccctcacttttgctcagcctagcagtctacttcactttattgccttgtaagtgtcaggcctcctgggcgctctggaaaagacagggagccaggccctctcacccctactggtaacaggtcattgctgggtgcacaagagggaggtgatttgcatcatggtcatgctgcatgggcttcactgggatgctgttaaacaccagaggagccaacctatcagaatcccagcagcaaaggaaaactcagattttagaggctttttacaataaagtagcgtaactctaggtcatgattgatttcaaatgcctgccatgaatgatttgtaagtaattatgtaggatccatcaaagcagtattgtaggcttttgaattgtcccagtggatccgggaccccatttcactgtctctcttgatcgtgttaatgatgcaatcagagttcaagacaggccccatgaagtctgactgcactgggatggagaaatgaatttcttcccactgaaggaaactctttctcattcgcagccaagacgggagtgccactgttcctctcttcactcctgagatactgcttctggaagcgggtgtcacttcctctctagtacctcttctcttctctgaagtgtgtgactatctcctagtgtttaaatttggcagttactcgccatgtatgtcagcatagaaaaggaaatgtttttaccttatctcctgtatgtatgatagaacttaaaagaaatgtgcatttgttttcatagccccagcagagaaaatcctcttcatagattaaatgtgctgctgtggacaggagggaaaaaaaaaccctctacatattgaaaggcaccaaatgtaatatctgacactgttaagatgcccaaaagagcaaagttgtagtggagatgcagggtcatttccccatgccatccacagtgtttgttagtgagtccacggctgacttgcagtgataaagaaaagcatggagctgtgtctgcagacaatggtggctgcatctgtaagtggcttcagaggcagcagccctggggaaattgatgggtgtggcagtggacctgtgaagagggagaatctagccttcagcctgtccagtgttaaccactagagaaactgagctttatatccttttttaatgcctgtgaattttagcatattgaaacattagagcaaatactcaggggatttttcattaaacatccctcagataatttagctatatatcattagaaagggaaagctatcatttttattttaaaactaaacaaggccatcttataaactgtcaccaaagtcttcccttttttattgcatgtgtgccttgaatttcataaaacattaattcacaatgggggtcagaatgtactcttgttgaaacacttcttgtaccattttatgttcatattatgtttgagagggtaaaaatgtatgagcagcttaactgaagtagaactattcatgatgcttttcacacattgtggcataagatgtaaagtttgtaattaatgttaatttctgtgcattttaatattcttttataattattaatgttaatttctgtgcattttaatattcttttataattatgagcattttaataaattcatttttacaaacaaaaaaaaaaa

SEQ ID NO: 437212 - DNA, 3200 bp, Homo sapiens
cacgtcatctactctgtgaaatttttcatttcatatgcaattcccgatgtatcaaaacgcacaaagagcaagatccagagagaaaaatacctaacccaaaagcttcttcatgagaatcacctcaaagatatgacgaaaaatatgggggtgatagctgagcggatgatagaagcagtagataacaatttacggccaaaatcagaataagagctttatgttctgagaagcactttaaggaatttagctttgtcaaaatatattaggaatcactaatgagaatgtgtaagttaaatcactttggcaaatatgagtctcaactattgccatttcctcatgtattatttttcagtttcagctagcgatgcagaaactggaaaatgtaaaacttagatcatgaagggcataaaacttatcacccggaaaacctcaatgttacctttttctgataaattggaattttacagaaaaagtccctcagtgtgcttaaaaaccaccccttctaaagtagaatggattcttttttttctgtttgattattttcatttctgtctattctcaggcgcatgatctcctttatttttaagccatgtttcatttcttcacttggctagatctgttccagggtcatcttttccttacagtaccatcattatagatttaatttaatagctttcatgtgattaaaaatagctaactagactcaaggattcacaatatttaggtgtattttcaatacctccagaaaggaaacctcagttaatcagaggaaatagtttcagtcttcatttgagcatgtctttccatctcaaaaaaatactcttagtaggttggagtgaagatagcaaggttttgaagcatatttgtcctaatccacagtgacactttttatcttccaggagcactcctaggaggttccgtgcctaatcaatgttgactgctttgcagatctcaagggaataaaatgacaaaagcagggaaagttacagattcaaacagcattttaactcatgttgatctggataattaatcttttctaaagatgtgtagtttcttggaaaacagtgatatcacatgattaaaattacatttttatcaacataattgtctggaaaagataagcccctcaattttctaccagttgacttttattcattagatacagaaggtgcagtattacacatcaccagctgcctttgtgaatggctcactacacagccattggggtacaactgtgtgcatgggcagaaacagcaagtgccctcattgtggtcattgggtggggagtgccttttgtcaaggagtctgcaggaattggcttatttctgtatgccaaagtgatcaacacaccaaagtctctgccataaagaatgtggcttccttgcatcctccatcctgttactctgggcccagtaatttgatgtaactgtctgattgtactagagacaggagtatacccagcttattcataatcaagtaaagagactcagattagatttgattttttagcctcctctagagccaatcaggcagttaagagtaataaaggaaaagggtttggtcacaaaccctaccattatctggagattacttcctgctgcactcctgtcttgccatgcacgtcttgccccctcacttttgctcagcctagcagtctacttcactttattgccttgtaagtgtcaggcctcctgggcgctctggaaaagacagggagccaggccctctcacccctactggtaacaggtcattgctgggtgcacaagagggaggtgatttgcatcatggtcatgctgcatgggcttcactgggatgctgttaaacaccagaggagccaacctatcagaatcccagcagcaaaggattgatttcaaatgcctgccatgaatgatttgtaagtaattatgtaggatccatcaaagcagtattgtaggcttttgaattgtcccagtggatccgggaccccatttcactgtctctcttgatcgtgttaatgatgcaatcagagttcaagacaggccccatgaagtctgactgcactgggatggagaaatgaatttcttcccactgaaggaaactctttctcattcgcagccaagacgggagtgccactgttcctctcttcactcctgagatactgcttctggaagcgggtgtcacttcctctctagtacctcttctcttctctgaagtgtgtgactatctcctagtgtttaaatttggcagttactcgccatgtatgtcagcatagaaaaggaaatgtttttaccttatctcctgtatgtatgatagaacttaaaagaaatgtgcatttgttttcatagccccagcagagaaaatcctcttcatagattaaatgtgctgctgtggacaggagggaaaaaaaaaccctctacatattgaaaggcaccaaatgtaatatctgacactgttaagatgcccaaaagagcaaagttgtagtggagatgcagggtcatttccccatgccatccacagtgtttgttagtgagtccacggctgacttgcagtgataaagaaaagcatggagctgtgtctgcagacaatggtggctgcatctgtaagtggcttcagaggcagcagccctggggaaattgatgggtgtggcagtggacctgtgaagagggagaatctagccttcagcctgtccagtgttaaccactagagaaactgagctttatatccttttttaatgcctgtgaattttagcatattgaaacattagagcaaatactcaggggatttttcattaaacatccctcagataatttagctatatatcattagaaagggaaagctatcatttttattttaaaactaaacaaggccatcttataaactgtcaccaaagtcttcccttttttattgcatgtgtgccttgaatttcataaaacattaattcacaatgggggtcagaatgtactcttgttgaaacacttcttgtaccattttatgttcatattatgtttgagagggtaaaaatgtatgagcagcttaactgaagtagaactattcatgatgcttttcacacattgtggcataagatgtaaagtttgtaattaatgttaatttctgtgcattttaatattcttttataattattaatgttaatttctgtgcattttaatattcttttataattatgagcattttaataaattcatttttacaaacaaaaaaaaaaa

SEQ ID NO: 437213 - DNA, 389 bp, Homo sapiens
gtgctgtgccagagagccacagtgtagagtgcaaggacattcctcaggaacatttgtcccaataggttggatatatttatgtccctggaagaaattttccagtcccatctatgctgatgggcctgctgagtatagactcaggaaagctgccccactgctacagccttttgggaatgactgaatgactttctctgtgccatgttttcaggccatcttggcagcaggcagcatgatgcagacccacggggactttgatgttgccctcaccaaatacagagttgtggcttgtgctgttccagaaagtcctccactctggaataacattggaatgtgtttctttggcaagaagaaatatgtggcggtgagtgtcccctcatgttctttgtttg

SEQ ID NO: 437214 - DNA, 507 bp, Homo sapiens
taaaaattgctcttaatttttaaactctcaatacaataaattttgaccttaccattattccagagattcagtattaaaaaaaaaaaagtcgacgcggccgcgtcgacctttaatagtatacatttaaaagaaaaaaaacaaaagccctggaagttgaggccaagcctgctgagtattgcagctgcatttgcccaaagggaatccagaacaagtccctccctgtattttgttcttgagaggggtcagtctagaagctagatcctatcaggatgaggagcagcagcccagggcttgtctggatcagcaccaacgattttaaagaaaaaaggaagagtttcttagatgagtaattgttattgaagatagtcagtgataaccactgaccagatgctatcaatacactatgtgtcctttttagaataaagattacatatcatcattcctttggggaaaattgttattcaggtataaaaacaagagatcataataaaaacctaaaagaaccta

SEQ ID NO: 437215 - DNA, 723 bp, Homo sapiens
ctgaccaacccaatcaaccacctcatagagaaaaggcttcagaattctctgctggatgaaatatgattaaaatgtgggactagtagggttagtcttctaagaattttgaggtaataattatggaaaatatatcttttacagatttcttttgggaaaacataaagctgccattgaagtatataatgaagcagctaaactcaaccagaaagattgggggtaagtagagaactttcagttctttcttattagtaaacttgctaatggttccatttatcatctggctgtcttatttctgaattcttacattccaaaaatgtcttgattttaacctcatacttaattcatgatttgtataagtataggatcaaaaaccatgtttcctcataactttgcaggcattgctgcatgattttctagcagtttgctgacgagcagtctcttaccagtctgattcttgttgatttgacccctagaagctttgggtatttttttcgtcattggaattccacagtatcagcaataggcatctagttgtgtttcatgtctttttcccgtccccatctgtgtgacattcaattgactctttcattctgaagacccttgcctttctttgggtcagggcctttgagtagttctttatttttcccctccccttctctttgtgtcaattgaggattgtgtgtaaatgcaacagaaaatttgactaaacattggctttacaaa

SEQ ID NO: 437216 - DNA, 769 bp, Homo sapiens
gcagcggtgggctgagctaaaatggctgaggagagagtcgcgacgagaactcaatttcctgtatctactgagtctcaaaaaccccggcagaaaaaagctccagagtttcctattttggagaagcagaactggttgattcatcttcattatatccggaaagattatgaagcctgcaaggctgttatcaaagaacagcttcaagagactcagggattgtgtgaatatgctatctatgtccaagcattgatatttcgcctagaaggaaatatccaagaatccctagaactcttccagacatgtgcagttcttagtcctcagagtgctgataacctcaagcaggtggccagatctttatttcttttgggaaaacataaagctgccattgaagtatataatgaagcagctaaactcaaccagaaagattgggagatcagccataacctaggagtttgctacatatacctgaagcagttcaacaaggtaatttatagaagtggtgatagatttcactgagggtgcacttgttgcagaagttgttacattgctcatttggtattatccctagtgcttgcagaggtttttggaactgaaaattgaaagtacctttatacatttttttctgttttaattctcacttgtcattattcatctgttgttttctgcttgtaataagaacatggaaagttctagaaatatgagggaatggcagtttttctcctttcttctttttctctacctccagttaaatttcccagtttagaaacagatg

SEQ ID NO: 437217 - DNA, 661 bp, Homo sapiens
gcagcggtgggctgagctaaaatggctgaggagagagtcgcgacgagaactcaatttcctgtatctactgagtctcaaaaaccccggcagaaaaaagctccagagtttcctattttggagaagcagaactggttgattcatcttcattatatccggaaagattatgaagcctgcaaggctgttatcaaagaacagcttcaagagactcagggattgtgtgaatatgctatctatgtccaagcattgatatttcgcctagaaggaaatatccaagaatccctagaactcttccagacatgtgcagttcttagtcctcagagtgctgataacctcaagcaggtggccagatctttatttcttttgggaaaacataaagctgccattgaagtatataatgaagcagctaaactcaaccagaaagattgggggtaagtagagaactttcagttctttcttattagtaaacttgctaatggttccatttatcatctggctgtcttatttctgaattcttacattccaaaaatgtcttgattttaacctcatacttaattcatgatttgtataagtataggatcgagcagctcttacaagctggtcttgtgatgaccctagacctttggattttttcgcaatgaattcccaggttagcaattgggtt

SEQ ID NO: 437218 - DNA, 332 bp, Homo sapiens
tttaattcaagataaaacttgactcttccagaacaagtccctccctgtattttgttcttgagaggggtcagtctagaagctagatcctatcaggatgaggagcagcagcccagggcttgtctggatcagcaccaacgattttaaagaaaaaaggaagagtttcttagatgagtaattgttattgaagatagtcagtgataaccactgaccagatgctatcaatacactatgtgtcctttttagaataaagattacatatcatcattcctttggggaaaattgttattcaggtataaaaacaagagatcataataaaaacctaaaagaaccta

SEQ ID NO: 437219 - DNA, 555 bp, Homo sapiens
aactccttgattcttctccacaggtctgcttagcacgtatgtacctaccttgctgcataatggagaaatctctacttaaccagttttgttttgtttttgtgtaatgagaaggatctctaaatgaccatttgttgcagagcccccagctccatagaatctctgtctgccacaggtgtaaccctttagtaaacctgaactatgctgtgctgctgtacaaccagggcgagaagaagaacgccctggcccaatatcaggagatggagaagaaagtcagcctactcaaggacaatagctctctggaatttgactctgagatggtggagatggctcagaagttgggagctgctctccaggttggggaggcactggtctggaccaaaccagttaaagatcccaaatcaaagcaccagaccacttcaaccagcaaacctgccagtttccagcagcctctgggctctaatcaagctctaggacaggcaatgtcttcagcagctgcatacaggacgctcccctcaggtaggaccatacagagctccatgaagacctggcaggtac

SEQ ID NO: 437220 - DNA, 639 bp, Homo sapiens
gttctcttcagactcatatgtccaacgtagtattggccacaaggggagaaaaaaaacacagggtggctaaattggcacttgtttccttaaggcgagctatgtagtaggtaacagctactcacagacttagttggatggtctatacactggtctttccaattttagcaatatgttattaagtatatcctgttatgcaatgtttaatttttactgctttatcagaagttgacacgtaaatatttttcagtgactcattgaaggcaaacttgactgttgctttatttctcagttatagtcttcccttatagttaatgggtcagtcccactggttccagaaaatatggggtttcctcttgaactctaacagcaaaaaagaatgatttcttctgaaattgtggaacatgaggattcaagtttttattttgttactaggtgctggaggaacatcccagttcacaaagcccccatctcttcctctggagccagagcctgcggtggaatcaagtccaactgtggtcccagctacttgggaggttgaagtgggaggattgcttgaaccctggagattgaggctgcagtgagccatgattgtgccactgcactccagcctgggcaatagaatgagaccctctctcctga

SEQ ID NO: 437221 - DNA, 384 bp, Homo sapiens
tagcggaacaagcaaacaagtattaaagaaaaatttgagaagccccaaattctatggaaaaaaaatttatgataaatccctacaaagagctgagtgcggtgggtagctcatgcctgtaatcccagcacttagggagggggagtattgcttgagcccaggagttcaagaccagcctgggtaacatagtgagacctacgtctctccaaaataatttaaaaaatacagaataagttagcagggcacggtgtcacatgcctgtggtcccagctacttgggaggttgaagtgggaggattgcttgaaccctggagattgaggctgcagtgagccatgattgtgccactgcactccagcctgggcaatagaatgagaccctctctcctga

SEQ ID NO: 437222 - DNA, 2581 bp, Homo sapiens
gggaactggtcgcctggggcaagtctggatacttagcagcacaggtcctgttctaggactgtagtccctcttggggtgcgctggacggagaagggagacttttcaccagtaatggctcttaccgtagtgccatctttttctgtctcgggggtttggaagagaactcaatttcctgtatctactgagtctcaaaaaccccggcagaaaaaagctccagagtttcctattttggagaagcagaactggttgattcatcttcattatatccggaaagattatgaagcctgcaaggctgttatcaaagaacagcttcaagagactcagggattgtgtgaatatgctatctatgtccaagcattgatatttcgcctagaaggaaatatccaagaatccctagaactcttccagacatgtgcagttcttagtcctcagagtgctgataacctcaagcaggtggccagatctttatttcttttgggaaaacataaagctgccattgaagtatataatgaagcagctaaactcaaccagaaagattgggagatcagccataacctaggagtttgctacatatacctgaagcagttcaacaaggcacaagaccagttgcacaatgccctgaatcttaataggcacgatctgacttatataatgctggggaagatccacttgctggagggagacttggacaaggccattgaagtctacaagaaagcagtggagttctcaccagaaaatacagagcttcttacaactttaggattactctacttacagctcggcatttaccagaaggcatttgaacatcttggcaatgcactgacttatgaccctaccaactacaaggccatcttggcagcaggcagcatgatgcagacccacggggactttgatgttgccctcaccaaatacagagttgtggcttgtgctgttccagaaagtcctccactctggaataacattggaatgtgtttctttggcaagaagaaatatgtggcggccatcagctgcctgaaacgagccaactacttggcacccttcgattggaagattctgtataatttgggccttgtccatttgaccatgcagcagtatgcatcagcttttcattttctcagtgcggccatcaacttccagccaaagatgggggagctctacatgctcttggcagtggctctgaccaatctggaagatacagaaaatgccaagagagcctacgcagaagcagtccacctggataagtgtaaccctttagtaaacctgaactatgctgtgctgctgtacaaccagggcgagaagaagaacgccctggcccaatatcaggagatggagaagaaagtcagcctactcaaggacaatagctctctggaatttgactctgagatggtggagatggctcagaagttgggagctgctctccaggttggggaggcactggtctggaccaaaccagttaaagatcccaaatcaaagcaccagaccacttcaaccagcaaacctgccagtttccagcagcctctgggctctaatcaagctctaggacaggcaatgtcttcagcagctgcatacaggacgctcccctcaggtgctggaggaacatcccagttcacaaagcccccatctcttcctctggagccagagcctgcggtggaatcaagtccaactgaaacatcagaacaaataagagagaaataagaatagaatgaatgaccccaaaatagggttttcttgggcgaggatgtgctggattaggaaaggtgacatgacacaggcagagcagagtggcacccaccacagaatacagtgtgtgttattacgaggagccagcagttgagcctaaggtccttctacctacctggtattggcatttgaggtcggaaaccctctactgccccataagccaggaaaagtgaaaagagaacacagttcctttaagaactggcagcaaggcttgaggccttatgtatgtagctgagtcagcaaggtacatgatgctgtctgctttcaaaaggacttttctctcctagctgactgactccttccttagttcaaggaacagctgagacagacctctgctgagtagctctgtgatgacaaagccttggtttaactgaggtgatcctcaggttgtgaggtttattagtccccaaggcaaacacaaatattagattaataatccaactttaatagtatacatttaaaagaaaaaaaacaaaagccctggaagttgaggccaagcctgctgagtattgcagctgcatttgcccaaagggaatccagaacaagtccctccctgtattttgttcttgagaggggtcagtctagaagctagatcctatcaggatgaggagcagcagcccagggcttgtctggatcagcaccaacgattttaaagaaaaaaggaagagtttcttagatgagtaattgttattgaagatagtcagtgataaccactgaccagatgctatcaatacactatgtgtcctttttagaataaagattacatatcatcattcctttggggaaaattgttattcaggtataaaaacaagagatcataataaaaacctaaaagaaccta

SEQ ID NO: 437223 - DNA, 2398 bp, Homo sapiens
gcagcggtgggctgagctaaaatggctgaggagagagtcgcgacgagaactcaatttcctgtatctactgagtctcaaaaaccccggcagaaaaaagctccagagtttcctattttggagaagcagaactggttgattcatcttcattatatccggaaagattatgaagcctgcaaggctgttatcaaagaacagcttcaagagactcagggattgtgtgaatatgctatctatgtccaagcattgatatttcgcctagaaggaaatatccaagaatccctagaactcttccagacatgtgcagttcttagtcctcagagtgctgataacctcaagcaggtggccagatctttatttcttttgggaaaacataaagctgccattgaagtatataatgaagcagctaaactcaaccagaaagattgggagatcagccataacctaggagtttgctacatatacctgaagcagttcaacaaggcacaagaccagttgcacaatgccctgaatcttaataggcacgatctgacttatataatgctggggaagatccacttgctggagggagacttggacaaggccattgaagtctacaagaaagcagtggagttctcaccagaaaatacagagcttcttacaactttaggattactctacttacaggccatcttggcagcaggcagcatgatgcagacccacggggactttgatgttgccctcaccaaatacagagttgtggcttgtgctgttccagaaagtcctccactctggaataacattggaatgtgtttctttggcaagaagaaatatgtggcggccatcagctgcctgaaacgagccaactacttggcacccttcgattggaagattctgtataatttgggccttgtccatttgaccatgcagcagtatgcatcagcttttcattttctcagtgcggccatcaacttccagccaaagatgggggagctctacatgctcttggcagtggctctgaccaatctggaagatacagaaaatgccaagagagcctacgcagaagcagtccacctggataagtgtaaccctttagtaaacctgaactatgctgtgctgctgtacaaccagggcgagaagaagaacgccctggcccaatatcaggagatggagaagaaagtcagcctactcaaggacaatagctctctggaatttgactctgagatggtggagatggctcagaagttgggagctgctctccaggttggggaggcactggtctggaccaaaccagttaaagatcccaaatcaaagcaccagaccacttcaaccagcaaacctgccagtttccagcagcctctgggctctaatcaagctctaggacaggcaatgtcttcagcagctgcatacaggacgctcccctcaggtgctggaggaacatcccagttcacaaagcccccatctcttcctctggagccagagcctgcggtggaatcaagtccaactgaaacatcagaacaaataagagagaaataagaatagaatgaatgaccccaaaatagggttttcttgggcgaggatgtgctggattaggaaaggtgacatgacacaggcagagcagagtggcacccaccacagaatacagtgtgtgttattacgaggagccagcagttgagcctaaggtccttctacctacctggtattggcatttgaggtcggaaaccctctactgccccataagccaggaaaagtgaaaagagaacacagttcctttaagaactggcagcaaggcttgaggccttatgtatgtagctgagtcagcaaggtacatgatgctgtctgctttcaaaaggacttttctctcctagctgactgactccttccttagttcaaggaacagctgagacagacctctgctgagtagctctgtgatgacaaagccttggtttaactgaggtgatcctcaggttgtgaggtttattagtccccaaggcaaacacaaatattagattaataatccaactttaatagtatacatttaaaagaaaaaaaacaaaagccctggaagttgaggccaagcctgctgagtattgcagctgcatttgcccaaagggaatccagaacaagtccctccctgtattttgttcttgagaggggtcagtctagaagctagatcctatcaggatgaggagcagcagcccagggcttgtctggatcagcaccaacgattttaaagaaaaaaggaagagtttcttagatgagtaattgttattgaagatagtcagtgataaccactgaccagatgctatcaatacactatgtgtcctttttagaataaagattacatatcatcattcctttggggaaaattgttattcaggtataaaaacaagagatcataataaaaacctaaaagaaccta

SEQ ID NO: 437224 - DNA, 2412 bp, Homo sapiens
gcagcggtgggctgagctaaaatggctgaggagagagtcgcgacgagaactcaatttcctgtatctactgagtctcaaaaaccccggcagaaaaaagctccagagtttcctattttggagaagcagaactggttgattcatcttcattatatccggaaagattatgaagcctgcaaggctgttatcaaagaacagcttcaagagactcagggattgtgtgaatatgctatctatgtccaagcattgatatttcgcctagaaggaaatatccaagaatccctagaactcttccagacatgtgcagttcttagtcctcagagtgctgataacctcaagcaggtggccagatctttatttcttttgggaaaacataaagctgccattgaagtatataatgaagcagctaaactcaaccagaaagattgggagatcagccataacctaggagtttgctacatatacctgaagcagttcaacaaggcacaagaccagttgcacaatgccctgaatcttaataggcacgatctgacttatataatgctggggaagatccacttgctggagggagacttggacaaggccattgaagtctacaagaaagcagtggactcggcatttaccagaaggcatttgaacatcttggcaatgcactgacttatgaccctaccaactacaaggccatcttggcagcaggcagcatgatgcagacccacggggactttgatgttgccctcaccaaatacagagttgtggcttgtgctgttccagaaagtcctccactctggaataacattggaatgtgtttctttggcaagaagaaatatgtggcggccatcagctgcctgaaacgagccaactacttggcacccttcgattggaagattctgtataatttgggccttgtccatttgaccatgcagcagtatgcatcagcttttcattttctcagtgcggccatcaacttccagccaaagatgggggagctctacatgctcttggcagtggctctgaccaatctggaagatacagaaaatgccaagagagcctacgcagaagcagtccacctggataagtgtaaccctttagtaaacctgaactatgctgtgctgctgtacaaccagggcgagaagaagaacgccctggcccaatatcaggagatggagaagaaagtcagcctactcaaggacaatagctctctggaatttgactctgagatggtggagatggctcagaagttgggagctgctctccaggttggggaggcactggtctggaccaaaccagttaaagatcccaaatcaaagcaccagaccacttcaaccagcaaacctgccagtttccagcagcctctgggctctaatcaagctctaggacaggcaatgtcttcagcagctgcatacaggacgctcccctcaggtgctggaggaacatcccagttcacaaagcccccatctcttcctctggagccagagcctgcggtggaatcaagtccaactgaaacatcagaacaaataagagagaaataagaatagaatgaatgaccccaaaatagggttttcttgggcgaggatgtgctggattaggaaaggtgacatgacacaggcagagcagagtggcacccaccacagaatacagtgtgtgttattacgaggagccagcagttgagcctaaggtccttctacctacctggtattggcatttgaggtcggaaaccctctactgccccataagccaggaaaagtgaaaagagaacacagttcctttaagaactggcagcaaggcttgaggccttatgtatgtagctgagtcagcaaggtacatgatgctgtctgctttcaaaaggacttttctctcctagctgactgactccttccttagttcaaggaacagctgagacagacctctgctgagtagctctgtgatgacaaagccttggtttaactgaggtgatcctcaggttgtgaggtttattagtccccaaggcaaacacaaatattagattaataatccaactttaatagtatacatttaaaagaaaaaaaacaaaagccctggaagttgaggccaagcctgctgagtattgcagctgcatttgcccaaagggaatccagaacaagtccctccctgtattttgttcttgagaggggtcagtctagaagctagatcctatcaggatgaggagcagcagcccagggcttgtctggatcagcaccaacgattttaaagaaaaaaggaagagtttcttagatgagtaattgttattgaagatagtcagtgataaccactgaccagatgctatcaatacactatgtgtcctttttagaataaagattacatatcatcattcctttggggaaaattgttattcaggtataaaaacaagagatcataataaaaacctaaaagaaccta

SEQ ID NO: 437225 - DNA, 1943 bp, Homo sapiens
gtgctgtgccagagagccacagtgtagagtgcaaggacattcctcaggaacatttgtcccaataggttggatatatttatgtccctggaagaaattttccagtcccatctatgctgatgggcctgctgagtatagactcaggaaagctgccccactgctacagccttttgggaatgactgaatgactttctctgtgccatgttttcaggccatcttggcagcaggcagcatgatgcagacccacggggactttgatgttgccctcaccaaatacagagttgtggcttgtgctgttccagaaagtcctccactctggaataacattggaatgtgtttctttggcaagaagaaatatgtggcggccatcagctgcctgaaacgagccaactacttggcacccttcgattggaagattctgtataatttgggccttgtccatttgaccatgcagcagtatgcatcagcttttcattttctcagtgcggccatcaacttccagccaaagatgggggagctctacatgctcttggcagtggctctgaccaatctggaagatacagaaaatgccaagagagcctacgcagaagcagtccacctggataagtgtaaccctttagtaaacctgaactatgctgtgctgctgtacaaccagggcgagaagaagaacgccctggcccaatatcaggagatggagaagaaagtcagcctactcaaggacaatagctctctggaatttgactctgagatggtggagatggctcagaagttgggagctgctctccaggttggggaggcactggtctggaccaaaccagttaaagatcccaaatcaaagcaccagaccacttcaaccagcaaacctgccagtttccagcagcctctgggctctaatcaagctctaggacaggcaatgtcttcagcagctgcatacaggacgctcccctcaggtgctggaggaacatcccagttcacaaagcccccatctcttcctctggagccagagcctgcggtggaatcaagtccaactgaaacatcagaacaaataagagagaaataagaatagaatgaatgaccccaaaatagggttttcttgggcgaggatgtgctggattaggaaaggtgacatgacacaggcagagcagagtggcacccaccacagaatacagtgtgtgttattacgaggagccagcagttgagcctaaggtccttctacctacctggtattggcatttgaggtcggaaaccctctactgccccataagccaggaaaagtgaaaagagaacacagttcctttaagaactggcagcaaggcttgaggccttatgtatgtagctgagtcagcaaggtacatgatgctgtctgctttcaaaaggacttttctctcctagctgactgactccttccttagttcaaggaacagctgagacagacctctgctgagtagctctgtgatgacaaagccttggtttaactgaggtgatcctcaggttgtgaggtttattagtccccaaggcaaacacaaatattagattaataatccaactttaatagtatacatttaaaagaaaaaaaacaaaagccctggaagttgaggccaagcctgctgagtattgcagctgcatttgcccaaagggaatccagaacaagtccctccctgtattttgttcttgagaggggtcagtctagaagctagatcctatcaggatgaggagcagcagcccagggcttgtctggatcagcaccaacgattttaaagaaaaaaggaagagtttcttagatgagtaattgttattgaagatagtcagtgataaccactgaccagatgctatcaatacactatgtgtcctttttagaataaagattacatatcatcattcctttggggaaaattgttattcaggtataaaaacaagagatcataataaaaacctaaaagaaccta

SEQ ID NO: 437226 - DNA, 2634 bp, Homo sapiens
aacagtgtataagcattcccttttctctgcagcctcaccaggatgttatattttgagtttttaataatagccattttgactggtgtgagatggttatctcactgtggtttcaatttgcatttctctaatcagtgatagagtttttcatatgcttgttggctgcatacatgacttcttttgaagtgtctgtttatgtcctttgcccattttaatgggattgtattcttcttgtaaatttgcttaagttccttatagatcctggatattagacctgcatggtttgcaaatattttctcccattttgtacattgtctgtttactgtgttgatagtttctttagatagctgggttctaatggaacacagaaatgtaaacagccataatgtaagagataacagcgatgctaactttacaaagtagagatggcattcaaactggatcctgaacaacaagctaaaatggaatagcacagaatggctgaggagccactgtgaagaaaggcatgcagccatgaaactgcagtgtcccttgctgttagtgggggttagtgttagagaatatgatgggagatgaatcaggaaagatattctggggtcagattatggaggtcatgcgtacagtgcaaggactttatcttagaggccatgtttgtccagctgtcttcctagatctcctcttaggtgcctggtaggagtgagtgcatagctggtggggaggtggaatgggcagggcttccagagcagctgtttttgttttatatattaggtgtcaaggaaatactgattttaaaaagtggggggagtgttttactgctaaatgaaagtgtaaagatcatggttatagatgtggggggccagtgaggattcctaagtaggatggtaatgtggtcagatttgtaaggcagtgagatacctggcagcgctgtggaaggtggaatggaggcaggtggggactttgacactggggaataaatggaaagcctaaaactacttgggcctgaacaagggcagtgtcagaaaagaaactgcaaaaaaaggatgcatagaacctggcaactgattgactgtagaagagatggttgaagatagcaccaggtatctaagctgacttagtaaactctggtgccatgagctgacagggtgaagtttactttgggggtagtctttaatactccttttgtcttctaagctgagctctccagctgcagtgctttctttgttgcagtggctctgaccaatctggaagatacagaaaatgccaagagagcctacgcagaagcagtccacctggataagtgtaaccctttagtaaacctgaactatgctgtgctgctgtacaaccagggcgagaagaagaacgccctggcccaatatcaggagatggagaagaaagtcagcctactcaaggacaatagctctctggaatttgactctgagatggtggagatggctcagaagttgggagctgctctccaggttggggaggcactggtctggaccaaaccagttaaagatcccaaatcaaagcaccagaccacttcaaccagcaaacctgccagtttccagcagcctctgggctctaatcaagctctaggacaggcaatgtcttcagcagctgcatacaggacgctcccctcaggtgctggaggaacatcccagttcacaaagcccccatctcttcctctggagccagagcctgcggtggaatcaagtccaactgaaacatcagaacaaataagagagaaataagaatagaatgaatgaccccaaaatagggttttcttgggcgaggatgtgctggattaggaaaggtgacatgacacaggcagagcagagtggcacccaccacagaatacagtgtgtgttattacgaggagccagcagttgagcctaaggtccttctacctacctggtattggcatttgaggtcggaaaccctctactgccccataagccaggaaaagtgaaaagagaacacagttcctttaagaactggcagcaaggcttgaggccttatgtatgtagctgagtcagcaaggtacatgatgctgtctgctttcaaaaggacttttctctcctagctgactgactccttccttagttcaaggaacagctgagacagacctctgctgagtagctctgtgatgacaaagccttggtttaactgaggtgatcctcaggttgtgaggtttattagtccccaaggcaaacacaaatattagattaataatccaactttaatagtatacatttaaaagaaaaaaaacaaaagccctggaagttgaggccaagcctgctgagtattgcagctgcatttgcccaaagggaatccagaacaagtccctccctgtattttgttcttgagaggggtcagtctagaagctagatcctatcaggatgaggagcagcagcccagggcttgtctggatcagcaccaacgattttaaagaaaaaaggaagagtttcttagatgagtaattgttattgaagatagtcagtgataaccactgaccagatgctatcaatacactatgtgtcctttttagaataaagattacatatcatcattcctttggggaaaattgttattcaggtataaaaacaagagatcataataaaaacctaaaagaaccta

SEQ ID NO: 437227 - DNA, 1304 bp, Homo sapiens
gcagcggtgggctgagctaaaatggctgaggagagagtcgcgacgagaactcaatttcctgtatctactgagtctcaaaaaccccggcagaaaaaagctccagagtttcctattttggagaagcagaactggttgattcatcttcattatatccggaaagattatgaagcctgcaaggctgttatcaaagaacagcttcaagagactcagggattgtgtgaatatgctatctatgtccaagcattgatatttcgcctagaaggaaatatccaagaatccctagaactcttccagacatgtgcagttcttagtcctcagagtgctgataacctcaagcaggtggccagatctttatttcttttgggaaaacataaagctgccattgaagtatataatgaagcagctaaactcaaccagaaagattgggagatcagccataacctaggagtttgctacatatacctgaagcagttcaacaaggcacaagaccagttgcacaatgccctgaatcttaataggcacgatctgacttatataatgctggggaagatccacttgctggagggagacttggacaaggccattgaagtctacaagaaagcagtggagttctcaccagaaaatacagagcttcttacaactttaggattactctacttacagctcggcatttaccagaaggcatttgaacatcttggcaatgcactgacttatgaccctaccaactacaaggccatcttggcagcaggcagcatgatgcagacccacggggactttgatgttgccctcaccaaatacagagttgtggcttgtgctgttccagaaagtcctccactctggaataacattggaatgtgtttctttggcaagaagaaatatgtggcggccatcagctgcctgaaacgagccaactacttggcacccttcgattggaagattctgtataatttgggccttgtccatttgaccatgcagcagtatgcatcagcttttcattttctcagtgcggccatcaacttccagccaaagatgggggagctctacatgctcttggcagtggctctgaccaatctggaagatacagaaaatgccaagagagcctacgcagaagcagtccacctggataagtatgcactttgttgagaatggtactggcgggggttggactctccaaagccatgaggtggtgccatacatagcattggtgctgcctgtgtcagcccagctgttcctctatggcattagtacatagcagacctcagtgtggagggatgtgtctcctaagtatgtggtggctcagcagg

SEQ ID NO: 437228 - DNA, 1471 bp, Homo sapiens
aacagtgtataagcattcccttttctctgcagcctcaccaggatgttatattttgagtttttaataatagccattttgactggtgtgagatggttatctcactgtggtttcaatttgcatttctctaatcagtgatagagtttttcatatgcttgttggctgcatacatgacttcttttgaagtgtctgtttatgtcctttgcccattttaatgggattgtattcttcttgtaaatttgcttaagttccttatagatcctggatattagacctgcatggtttgcaaatattttctcccattttgtacattgtctgtttactgtgttgatagtttctttagatagctgggttctaatggaacacagaaatgtaaacagccataatgtaagagataacagcgatgctaactttacaaagtagagatggcattcaaactggatcctgaacaacaagctaaaatggaatagcacagaatggctgaggagccactgtgaagaaaggcatgcagccatgaaactgcagtgtcccttgctgttagtgggggttagtgttagagaatatgatgggagatgaatcaggaaagatattctggggtcagattatggaggtcatgcgtacagtgcaaggactttatcttagaggccatgtttgtccagctgtcttcctagatctcctcttaggtgcctggtaggagtgagtgcatagctggtggggaggtggaatgggcagggcttccagagcagctgtttttgttttatatattaggtgtcaaggaaatactgattttaaaaagtggggggagtgttttactgctaaatgaaagtgtaaagatcatggttatagatgtggggggccagtgaggattcctaagtaggatggtaatgtggtcagatttgtaaggcagtgagatacctggcagcgctgtggaaggtggaatggaggcaggtggggactttgacactggggaataaatggaaagcctaaaactacttgggcctgaacaagggcagtgtcagaaaagaaactgcaaaaaaaggatgcatagaacctggcaactgattgactgtagaagagatggttgaagatagcaccaggtatctaagctgacttagtaaactctggtgccatgagctgacagggtgaagtttactttgggggtagtctttaatactccttttgtcttctaagctgagctctccagctgcagtgctttctttgttgcagtggctctgaccaatctggaagatacagaaaatgccaagagagcctacgcagaagcagtccacctggataagtatgcactttgttgagaatggtactggcgggggttggactctccaaagccatgaggtggtgccatacatagcattggtgctgcctgtgtcagcccagctgttcctctatggcattagtacatagcagacctcagtgtggagggatgtgtctcctaagtatgtggtggctcagcagg

SEQ ID NO: 437229 - DNA, 754 bp, Homo sapiens
gcagcggtgggctgagctaaaatggctgaggagagagtcgcgacgagaactcaatttcctgtatctactgagtctcaaaaaccccggcagaaaaaagctccagagtttcctattttggagaagcagaactggttgattcatcttcattatatccggaaagattatgaagcctgcaaggctgttatcaaagaacagcttcaagagactcagggattgtgtgaatatgctatctatgtccaagcattgatatttcgcctagaaggaaatatccaagaatccctagaactcttccagacatgtgcagttcttagtcctcagagtgctgataacctcaagcaggtggccagatctttatttcttttgggaaaacataaagctgccattgaagtatataatgaagcagctaaactcaaccagaaagattgggcattgctgcatgattttctagcagtttgctgacgagcagtctcttaccagtctgattcttgttgatttgacccctagaagctttgggtatttttttcgtcattggaattccacagtatcagcaataggcatctagttgtgtttcatgtctttttcccgtccccatctgtgtgacattcaattgactctttcattctgaagacccttgcctttctttgggtcagggcctttgagtagttctttatttttcccctccccttctctttgtgtcaattgaggattgtgtgtaaatgcaacagaaaatttgactaaacattggctttacaaa

SEQ ID NO: 437230 - DNA, 289 bp, Homo sapiens
tagctctctggaatttgactctgaggtatgtcttttattagctcccaagagtcataagtaagctctcaggagacttttaaaaatcaagcccagatcatccaaatccaaggtattacacgttcatggctgttctggctttgatgttcctagcagcatgagttcatcaattaataacagcctgagaaaaactttcctagaataataataaaaggaaattcaggcttactgagttgttattgctaattcaactcatcaaagttgaggtctgtgtctgtctgtagcttccttc

SEQ ID NO: 437231 - DNA, 2467 bp, Homo sapiens
gcagcggtgggctgagctaaaatggctgaggagagagtcgcgacgagaactcaatttcctgtatctactgagtctcaaaaaccccggcagaaaaaagctccagagtttcctattttggagaagcagaactggttgattcatcttcattatatccggaaagattatgaagcctgcaaggctgttatcaaagaacagcttcaagagactcagggattgtgtgaatatgctatctatgtccaagcattgatatttcgcctagaaggaaatatccaagaatccctagaactcttccagacatgtgcagttcttagtcctcagagtgctgataacctcaagcaggtggccagatctttatttcttttgggaaaacataaagctgccattgaagtatataatgaagcagctaaactcaaccagaaagattgggagatcagccataacctaggagtttgctacatatacctgaagcagttcaacaaggcacaagaccagttgcacaatgccctgaatcttaataggcacgatctgacttatataatgctggggaagatccacttgctggagggagacttggacaaggccattgaagtctacaagaaagcagtggagttctcaccagaaaatacagagcttcttacaactttaggattactctacttacagctcggcatttaccagaaggcatttgaacatcttggcaatgcactgacttatgaccctaccaactacaaggccatcttggcagcaggcagcatgatgcagacccacggggactttgatgttgccctcaccaaatacagagttgtggcttgtgctgttccagaaagtcctccactctggaataacattggaatgtgtttctttggcaagaagaaatatgtggcggccatcagctgcctgaaacgagccaactacttggcacccttcgattggaagattctgtataatttgggccttgtccatttgaccatgcagcagtatgcatcagcttttcattttctcagtgcggccatcaacttccagccaaagatgggggagctctacatgctcttggcagtggctctgaccaatctggaagatacagaaaatgccaagagagcctacgcagaagcagtccacctggataagtgtaaccctttagtaaacctgaactatgctgtgctgctgtacaaccagggcgagaagaagaacgccctggcccaatatcaggagatggagaagaaagtcagcctactcaaggacaatagctctctggaatttgactctgagatggtggagatggctcagaagttgggagctgctctccaggttggggaggcactggtctggaccaaaccagttaaagatcccaaatcaaagcaccagaccacttcaaccagcaaacctgccagtttccagcagcctctgggctctaatcaagctctaggacaggcaatgtcttcagcagctgcatacaggacgctcccctcaggtgctggaggaacatcccagttcacaaagcccccatctcttcctctggagccagagcctgcggtggaatcaagtccaactgaaacatcagaacaaataagagagaaataagaatagaatgaatgaccccaaaatagggttttcttgggcgaggatgtgctggattaggaaaggtgacatgacacaggcagagcagagtggcacccaccacagaatacagtgtgtgttattacgaggagccagcagttgagcctaaggtccttctacctacctggtattggcatttgaggtcggaaaccctctactgccccataagccaggaaaagtgaaaagagaacacagttcctttaagaactggcagcaaggcttgaggccttatgtatgtagctgagtcagcaaggtacatgatgctgtctgctttcaaaaggacttttctctcctagctgactgactccttccttagttcaaggaacagctgagacagacctctgctgagtagctctgtgatgacaaagccttggtttaactgaggtgatcctcaggttgtgaggtttattagtccccaaggcaaacacaaatattagattaataatccaactttaatagtatacatttaaaagaaaaaaaacaaaagccctggaagttgaggccaagcctgctgagtattgcagctgcatttgcccaaagggaatccagaacaagtccctccctgtattttgttcttgagaggggtcagtctagaagctagatcctatcaggatgaggagcagcagcccagggcttgtctggatcagcaccaacgattttaaagaaaaaaggaagagtttcttagatgagtaattgttattgaagatagtcagtgataaccactgaccagatgctatcaatacactatgtgtcctttttagaataaagattacatatcatcattcctttggggaaaattgttattcaggtataaaaacaagagatcataataaaaacctaaaagaaccta

SEQ ID NO: 437232 - DNA, 881 bp, Homo sapiens
gcagcggtgggctgagctaaaatggctgaggagagagtcgcgacgagaactcaatttcctgtatctactgagtctcaaaaaccccggcagaaaaaagctccagagtttcctattttggagaagcagaactggttgattcatcttcattatatccggaaagattatgaagcctgcaaggctgttatcaaagaacagcttcaagagactcagggattgtgtgaatatgctatctatgtccaagcattgatatttcgcctagaaggaaatatccaagaatccctagaactcttccagacatgtgcagttcttagtcctcagagtgctgataacctcaagcaggtggccagatctttatttcttttgggaaaacataaagctgccattgaagtatataatgaagcagctaaactcaaccagaaagattgggggtaagtagagaactttcagttctttcttattagtaaacttgctaatggttccatttatcatctggctgtcttatttctgaattcttacattccaaaaatgtcttgattttaacctcatacttaattcatgatttgtataagtataggatctttgctgacgagcagtctcttaccagtctgattcttgttgatttgacccctagaagctttgggtatttttttcgtcattggaattccacagtatcagcaataggcatctagttgtgtttcatgtctttttcccgtccccatctgtgtgacattcaattgactctttcattctgaagacccttgcctttctttgggtcagggcctttgagtagttctttatttttcccctccccttctctttgtgtcaattgaggattgtgtgtaaatgcaacagaaaatttgactaaacattggctttacaaa

SEQ ID NO: 437233 - DNA, 2882 bp, Homo sapiens
gcagcggtgggctgagctaaaatggctgaggagagagtcgcgacgagaactcaatttcctgtatctactgagtctcaaaaaccccggcagaaaaaagctccagagtttcctattttggagaagcagaactggttgattcatcttcattatatccggaaagattatgaagcctgcaaggctgttatcaaagaacagcttcaagagactcagggattgtgtgaatatgctatctatgtccaagcattgatatttcgcctagaaggaaatatccaagaatccctagaactcttccagacatgtgcagttcttagtcctcagagtgctgataacctcaagcaggtggccagatctttatttcttttgggaaaacataaagctgccattgaagtatataatgaagcagctaaactcaaccagaaagattgggagatcagccataacctaggagtttgctacatatacctgaagcagttcaacaaggcacaagaccagttgcacaatgccctgaatcttaataggcacgatctgacttatataatgctggggaagatccacttgctggagggagacttggacaaggccattgaagtctacaagaaagcagtggagttctcaccagaaaatacagagcttcttacaactttaggattactctacttacagctcggcatttaccagaaggcatttgaacatcttggcaatgcactgacttatgaccctaccaactacaaggccatcttggcagcaggcagcatgatgcagacccacggggactttgatgttgccctcaccaaatacagagttgtggcttgtgctgttccagaaagtcctccactctggaataacattggaatgtgtttctttggcaagaagaaatatgtggcggccatcagctgcctgaaacgagccaactacttggcacccttcgattggaagattctgtataatttgggccttgtccatttgaccatgcagcagtatgcatcagcttttcattttctcagtgcggccatcaacttccagccaaagatgggggagctctacatgctcttggcagtggctctgaccaatctggaagatacagaaaatgccaagagagcctacgcagaagcagtccacctggataagtgtaaccctttagtaaacctgaactatgctgtgctgctgtacaaccagggcgagaagaagaacgccctggcccaatatcaggagatggagaagaaagtcagcctactcaaggacaatagctctctggaatttgactctgagatggtggagatggctcagaagttgggagctgctctccaggttggggaggcactggtctggaccaaaccagttaaagatcccaaatcaaagcaccagaccacttcaaccagcaaacctgccagtttccagcagcctctgggctctaatcaagctctaggacaggcaatgtcttcagcagctgcatacaggacgctcccctcaggtgctggaggaacatcccagttcacaaagcccccatctcttcctctggagccagagcctgcggtggaatcaagtccaactgaaacatcagaacaaataagagagaaataagaatagaatgaatgaccccaaaatagggttttcttgggcgaggatgtgctggattaggaaaggtgacatgacacaggcagagcagagtggcacccaccacagaatacagtgtgtgttattacgaggagccagcagttgagcctaaggtccttctacctacctggtattggcatttgaggtcggaaaccctctactgccccataagccaggaaaagtgaaaagagaacacagttcctttaagaactggcagcaaggcttgaggccttatgtatgtagctgagtcagcaaggtacatgatgctgtctgctttcaaaaggacttttctctcctagctgactgactccttccttagttcaaggaacagctgagacagacctctgctgagtagctctgtgatgacaaagccttggtttaactgaggtgatcctcaggttgtgaggtttattagtccccaaggcaaacacaaatattagattaataatccaactttaatagtatacatttaaaagaaaaaaaacaaaagccctggaagttgaggccaagcctgctgagtattgcagctgcatttgcccaaagggaatccagaacaagtccctccctgtattttgttcttgagaggggtcagtctagaagctagatcctatcaggatgaggagcagcagcccagggcttgtctggatcagcaccaacgattttaaagaaaaaaggaagagtttcttagatgagtaattgttattgaagatagtcagtgataaccactgaccagatgctatcaatacactatgtgtcctttttagaataaagattacatatcatcattcctttggggaaaattgttattcaggtataaaaacaagagatcataataaaaacctaaaagaacctaaaaaaaaaaaaaaaaaaaaaaaaaaaagaaaaaaaaaaaaaaagacaaacacaaagaagaaaaaaaaacaaaacaaaagaaacacaaaataaaagcaatacaaaatagaaagacaaacagaaaagagagagagagaagtaagagagaggagacgagatcaagtaagcagagaagaaggagataagagaagcgaaagataacagaaaacaagacacagaaagcacaaagagacaaagagagagacaacaagacagaagaacaagcaagaagagaggctcggaacaaccgagataagaactcggcggggtgcgagaattacaaaaacgagaccaaagagaatatgcagacaaaacgaagaacaagagcagcaggctaaacggagcagaaagacatagaaaaatacaaaagggagaaa

SEQ ID NO: 437234 - DNA, 2355 bp, Homo sapiens
gcagcggtgggctgagctaaaatggctgaggagagagtcgcgacgagaactcaatttcctgtatctactgagtctcaaaaaccccggcagaaaaaagctccagagtttcctattttggagaagcagaactggttgattcatcttcattatatccggaaagattatgaagcctgcaaggctgttatcaaagaacagcttcaagagactcagggattgtgtgaatatgctatctatgtccaagatttcttttgggaaaacataaagctgccattgaagtatataatgaagcagctaaactcaaccagaaagattgggagatcagccataacctaggagtttgctacatatacctgaagcagttcaacaaggcacaagaccagttgcacaatgccctgaatcttaataggcacgatctgacttatataatgctggggaagatccacttgctggagggagacttggacaaggccattgaagtctacaagaaagcagtggagttctcaccagaaaatacagagcttcttacaactttaggattactctacttacagctcggcatttaccagaaggcatttgaacatcttggcaatgcactgacttatgaccctaccaactacaaggccatcttggcagcaggcagcatgatgcagacccacggggactttgatgttgccctcaccaaatacagagttgtggcttgtgctgttccagaaagtcctccactctggaataacattggaatgtgtttctttggcaagaagaaatatgtggcggccatcagctgcctgaaacgagccaactacttggcacccttcgattggaagattctgtataatttgggccttgtccatttgaccatgcagcagtatgcatcagcttttcattttctcagtgcggccatcaacttccagccaaagatgggggagctctacatgctcttggcagtggctctgaccaatctggaagatacagaaaatgccaagagagcctacgcagaagcagtccacctggataagtgtaaccctttagtaaacctgaactatgctgtgctgctgtacaaccagggcgagaagaagaacgccctggcccaatatcaggagatggagaagaaagtcagcctactcaaggacaatagctctctggaatttgactctgagatggtggagatggctcagaagttgggagctgctctccaggttggggaggcactggtctggaccaaaccagttaaagatcccaaatcaaagcaccagaccacttcaaccagcaaacctgccagtttccagcagcctctgggctctaatcaagctctaggacaggcaatgtcttcagcagctgcatacaggacgctcccctcaggtgctggaggaacatcccagttcacaaagcccccatctcttcctctggagccagagcctgcggtggaatcaagtccaactgaaacatcagaacaaataagagagaaataagaatagaatgaatgaccccaaaatagggttttcttgggcgaggatgtgctggattaggaaaggtgacatgacacaggcagagcagagtggcacccaccacagaatacagtgtgtgttattacgaggagccagcagttgagcctaaggtccttctacctacctggtattggcatttgaggtcggaaaccctctactgccccataagccaggaaaagtgaaaagagaacacagttcctttaagaactggcagcaaggcttgaggccttatgtatgtagctgagtcagcaaggtacatgatgctgtctgctttcaaaaggacttttctctcctagctgactgactccttccttagttcaaggaacagctgagacagacctctgctgagtagctctgtgatgacaaagccttggtttaactgaggtgatcctcaggttgtgaggtttattagtccccaaggcaaacacaaatattagattaataatccaactttaatagtatacatttaaaagaaaaaaaacaaaagccctggaagttgaggccaagcctgctgagtattgcagctgcatttgcccaaagggaatccagaacaagtccctccctgtattttgttcttgagaggggtcagtctagaagctagatcctatcaggatgaggagcagcagcccagggcttgtctggatcagcaccaacgattttaaagaaaaaaggaagagtttcttagatgagtaattgttattgaagatagtcagtgataaccactgaccagatgctatcaatacactatgtgtcctttttagaataaagattacatatcatcattcctttggggaaaattgttattcaggtataaaaacaagagatcataataaaaacctaaaagaaccta

SEQ ID NO: 437235 - DNA, 1868 bp, Homo sapiens
  misc_feature (66)..(66): n is a, c, g, or t
agcagcctgctgaggaacagtgtttcttacatcattcctccacccctagttttttgtagggagggngagtggatggggctttggaccctccatagctcccaaacggtcctgtgtcatattgggcttcccgtaagactgtattttataaaaacgcgctgtggaaggtggaatggaggcaggtggggactttgacactggggaataaatggaaagcctaaaactacttgggcctgaacaagggcagtgtcagaaaagaaactgcaaaaaaaggatgcatagaacctggcaactgattgactgtagaagagatggttgaagatagcaccaggtatctaagctgacttagtaaactctggtgccatgagctgacagggtgaagtttactttgggggtagtctttaatactccttttgtcttctaagctgagctctccagctgcagtgctttctttgttgcagtggctctgaccaatctggaagatacagaaaatgccaagagagcctacgcagaagcagtccacctggataagtgtaaccctttagtaaacctgaactatgctgtgctgctgtacaaccagggcgagaagaagaacgccctggcccaatatcaggagatggagaagaaagtcagcctactcaaggacaatagctctctggaatttgactctgagatggtggagatggctcagaagttgggagctgctctccaggttggggaggcactggtctggaccaaaccagttaaagatcccaaatcaaagcaccagaccacttcaaccagcaaacctgccagtttccagcagcctctgggctctaatcaagctctaggacaggcaatgtcttcagcagctgcatacaggacgctcccctcaggtgctggaggaacatcccagttcacaaagcccccatctcttcctctggagccagagcctgcggtggaatcaagtccaactgaaacatcagaacaaataagagagaaataagaatagaatgaatgaccccaaaatagggttttcttgggcgaggatgtgctggattaggaaaggtgacatgacacaggcagagcagagtggcacccaccacagaatacagtgtgtgttattacgaggagccagcagttgagcctaaggtccttctacctacctggtattggcatttgaggtcggaaaccctctactgccccataagccaggaaaagtgaaaagagaacacagttcctttaagaactggcagcaaggcttgaggccttatgtatgtagctgagtcagcaaggtacatgatgctgtctgctttcaaaaggacttttctctcctagctgactgactccttccttagttcaaggaacagctgagacagacctctgctgagtagctctgtgatgacaaagccttggtttaactgaggtgatcctcaggttgtgaggtttattagtccccaaggcaaacacaaatattagattaataatccaactttaatagtatacatttaaaagaaaaaaaacaaaagccctggaagttgaggccaagcctgctgagtattgcagctgcatttgcccaaagggaatccagaacaagtccctccctgtattttgttcttgagaggggtcagtctagaagctagatcctatcaggatgaggagcagcagcccagggcttgtctggatcagcaccaacgattttaaagaaaaaaggaagagtttcttagatgagtaattgttattgaagatagtcagtgataaccactgaccagatgctatcaatacactatgtgtcctttttagaataaagattacatatcatcattcctttggggaaaattgttattcaggtataaaaacaagagatcataataaaaacctaaaagaaccta

SEQ ID NO: 437236 - DNA, 862 bp, Homo sapiens
gcagcggtgggctgagctaaaatggctgaggagagagtcgcgacgagaactcaatttcctgtatctactgagtctcaaaaaccccggcagaaaaaagctccagagtttcctattttggagaagcagaactggttgattcatcttcattatatccggaaagattatgaagcctgcaaggctgttatcaaagaacagcttcaagagactcagggattgtgtgaatatgctatctatgtccaagcattgatatttcgcctagaaggaaatatccaagaatccctagaactcttccagacatgtgcagttcttagtcctcagagtgctgataacctcaagcaggtggccagatctttgggtaagtagagaactttcagttctttcttattagtaaacttgctaatggttccatttatcatctggctgtcttatttctgaattcttacattccaaaaatgtcttgattttaacctcatacttaattcatgatttgtataagtataggatcaaaaaccatgtttcctcataactttgcaggcattgctgcatgattttctagcagtttgctgacgagcagtctcttaccagtctgattcttgttgatttgacccctagaagctttgggtatttttttcgtcattggaattccacagtatcagcaataggcatctagttgtgtttcatgtctttttcccgtccccatctgtgtgacattcaattgactctttcattctgaagacccttgcctttctttgggtcagggcctttgagtagttctttatttttcccctccccttctctttgtgtcaattgaggattgtgtgtaaatgcaacagaaaatttgactaaacattggctttacaaa

SEQ ID NO: 437237 - DNA, 2796 bp, Homo sapiens
  misc_feature (2620)..(2620): n is a, c, g, or t
  misc_feature (2699)..(2700): n is a, c, g, or t
gagacagatgagtggctgcctcctgcacggatactaggatctaggttatccctgaggagaggatgatcttatacctaagaactactatatactcactctggacgttatatgctattgaagtttactgccccattgtcgtgaccattctgttcacagttgggccggctttacagcagttgtggtttgtatcaagatgggaactcaaacaagtcattcctcctaaggagctggtgtcttcatccagaagggacagtttgtgccagctctccagagagaaaagaacacggctggcagatccagctcctcgtatagtgccttcacccgggccaccttctcggcctccttctgcctgtaattttccttcaggatctggtactgttctggagtggcctgtagcagacactgaaccaccagccagctgcatttgttgtcctggaagtcattgccaactctgccagtcacactggggtccccaaagaagttcacagatctgccggaggcgctgggcaatgaccccgggactccaggccagaggggtctgaagctgtttgggaaagcagcgggactccttgggaagatggtcatggccccaagcccttccctggtgcaggtgtacaccagccccgcagctgtggctatggcaggatgggctgggcacctggcacccctacagtgccaccatctgcagcttcatcgagcagcagtttgtccagcagaagggccaacgttttgggcttgggagcctggcccacagcatccccttgggccaggcagacccctcgctggtccgttacattattgacctccccagctggacccagttccgccaggacaccggcaccacgcggactgtgcggagacacctgttcccccagcactcagcccctggccgaggtgtcgtctgggagtggctgagcgacgatggctcctggaccgcctatgaagccggcgtctgtgacgatctggagcagcaggtggccaggggcaaccagctcgtggacttggcccccctggggtacaactacactgtcaactacaccacccacacgcagaccaacaagacttccagcttctgctgcagcgtgcggcgccaagcagggccgccttacccagtgaccaccatcatcgctccgccgggccacacaggcgtcgcctgctcttgccaccagtgcctcagtggcagcagaactggccctgtgtcaggccgctaccgccactccatgaccaacctccctgcataccccgtcccccagcaccccccccacaggaccgcttctgtgtttgggacccaccaggcctttgcaccgtacaacaaaccctcactctccggggcccggtctgcgcccaggctgaacaccacgaacgcctgggacgcagctcctccttccctggggagccagcccctctaccgctccagcctctcccacctgggaccgcagcacctgcccccaggatcctccacctccggtgcagtcagtgcctccctccccagcggtccctcaagcagcccagggagcgtccctgccactgtgcccatgcagatgccaaagcccagcagagtccagcaggcgctcgcaggagcgaccccgaagccagagccagagccagagcaggtcataaaaaactacacggaagagctgaaagtgcccccagatgaggactgcatcatctgcatggagaagctgtccgcagcgtctggatacagcgatgtgactgacagcaaggcaatcgggcccctggctgtgggctgcctcaccaagtgcagccacgccttccacctgctgtgcctcctggccatgtactgcaacggcaataagggccctgagcaccccaatcccggaaagccgttcactgccagagggtttccccgccagtgctaccttccagacaacgcccagggccgcaagcctccaggggcttccagaacccggagacactggctgacattccggcctccccacagctgctgaccgatggccactacatgacgctgcccgtgtctccggaccagctgccctgtgacgaccccatggcgggcagcggtggtgcccccgtgctgcgggtgggccatgaccacggctgccaccagcagcccttctgcaacgcgcccctccctggccctggaccctatcgtacagaacctgctaaggccatcaaacctattgatcggaagtcagtccatcagatttgctctgggccagtggtactgagtctaagcactggatgaagaagatagtagaaaacagtctggatgctggtgccactaatgttgatctaaagcttaaggactatggaatggatctcattgaagtttcaggcaatggatgtggggtagaagaagaaaacttcgaaggcttaatgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagcttcttgagggctccccagccatgcttcctgtacngcctgcaaaactgactcctagaagtaccccaccccacccctgctccttggaggacaacgtgatcactgtattcagctcnntcaagaatggtccaggttcttctagatgatctgcacaaatggttcctctcctccttcctgatgtctgccattagcattggaataaagttcctgctg

SEQ ID NO: 437238 - DNA, 1981 bp, Homo sapiens
gagacagatgagtggctgcctcctgcacggatactaggatctaggttatccctgaggagaggatgatcttatacctaagaactactatatactcactctggacgttatatgctattgaagtttactgccccattgtcgtgaccattctgttcacagttgggccggctttacagcagttgtggtttgtatcaagatgggaactcaaacaagtcattcctcctaaggagctggtgtcttcatccagaagggacagtttgtgccagctctccagagagaaaagaacacggctggcagatccagctcctcgtatagtgccttcacccgggccaccttctcggcctccttctgcctgtaattttccttcaggatctggtactgttctggagtggcctgtagcagacactgaaccaccagccagctgcatttgttgtcctggaagtcattgccaactctgccagtcacactggggtccccaaagaagttcacagatctgccggaggcgctgggcaatgaccccgggactccaggccagaggggtctgaagctgtttgggaaagcagcgggactccttgggaagatggtcatggccccaagcccttccctggtgcaggtgtacaccagccccgcagctgtggctatggcaggatgggctgggcacctggcacccctacagtgccaccatctgcagcttcatcgagcagcagtttgtccagcagaagggccaacgttttgggcttgggagcctggcccacagcatccccttgggccaggcagacccctcgctggtccgttacattattgacctccccagctggacccagttccgccaggacaccggcaccacgcggactgtgcggagacacctgttcccccagcactcagcccctggccgaggtgtcgtctgggagtggctgagcgacgatggctcctggaccgcctatgaagccggcgtctgtgacgatctggagcagcaggtggccaggggcaaccagctcgtggacttggcccccctggggtacaactacactgtcaactacaccacccacacgcagaccaacaagacttccagcttctgctgcagcgtgcggcgccaagcagggccgccttacccagtgaccaccatcatcgctccgccgggccacacaggcgtcgcctgctcttgccaccagtgcctcagtggcagcagaactggccctgtgtcaggccgctaccgccactccatgaccaacctccctgcataccccgtcccccagcaccccccccacaggaccgcttctgtgtttgggacccaccaggcctttgcaccgtacaacaaaccctcactctccggggcccggtctgcgcccaggctgaacaccacgaacgcctgggacgcagctcctccttccctggggagccagcccctctaccgctccagcctctcccacctgggaccgcagcacctgcccccaggatcctccacctccggtgcagtcagtgcctccctccccagcggtccctcaagcagcccagggagcgtccctgccactgtgcccatgcagatgccaaagcccagcagagtccagcaggcgctcgcaggagcgaccccgaagccagagccagagccagagcaggtcataaaaaactacacggaagagctgaaagtgcccccagatgaggactgcatcatctgcatggagaagctgtccgcagcgtctggatacagcgatgtgactgacagcaaggcaatcgggcccctggctgtgggctgcctcaccaagtgcagccacgccttccacctgctgtgcctcctggccatgtactgcaacggcaataagggccctgagcaccccaatcccggaaagccgttcactgccagagggtttccccgccagtgctaccttccagacaacgcccagggccgcaaggtgagtgccaccatgagccccgggggtggacggggccctgaccaggcggcaggaggccaggcgccacactggac

SEQ ID NO: 437239 - DNA, 1408 bp, Homo sapiens
  misc_feature (1232)..(1232): n is a, c, g, or t
  misc_feature (1311)..(1312): n is a, c, g, or t
gccacagcagggtgtgcgtcgaggaaccttgggttgggagtggcagggccaggcgtgtgggtgtcaggagcccaggcacaaggccccagagtcccagaggagactcagatgggccctagccctttcggtctcctgtcttgagccaaggtggatcgtagggcctggtgcagggtgggaagataacggggcagcaggcagcgggcactggctgccagccaaggtccacctgtggtggatggaggcttctttttgtcttgttgaaccatgagcctttcccctggtttccctccacttctccacagctcagagggaaattcaggaacattcggggttggcatctcggagcgggggaggagctggagctgtgcaggggcctgtccctgtgcgggctctcggagcaccctatcctggtgtctgttcctcccgcagggccctgagcaccccaatcccggaaagccgttcactgccagagggtttccccgccagtgctaccttccagacaacgcccagggccgcaagcctccaggggcttccagaacccggagacactggctgacattccggcctccccacagctgctgaccgatggccactacatgacgctgcccgtgtctccggaccagctgccctgtgacgaccccatggcgggcagcggtggtgcccccgtgctgcgggtgggccatgaccacggctgccaccagcagcccttctgcaacgcgcccctccctggccctggaccctatcgtacagaacctgctaaggccatcaaacctattgatcggaagtcagtccatcagatttgctctgggccagtggtactgagtctaagcactggatgaagaagatagtagaaaacagtctggatgctggtgccactaatgttgatctaaagcttaaggactatggaatggatctcattgaagtttcaggcaatggatgtggggtagaagaagaaaacttcgaaggcttaatgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagcttcttgagggctccccagccatgcttcctgtacngcctgcaaaactgactcctagaagtaccccaccccacccctgctccttggaggacaacgtgatcactgtattcagctcnntcaagaatggtccaggttcttctagatgatctgcacaaatggttcctctcctccttcctgatgtctgccattagcattggaataaagttcctgctg

SEQ ID NO: 437240 - DNA, 240 bp, Homo sapiens
taccggtgtgagccaccacacccctcctgagtctctctgaattgcccaggaaaacaaaaccaaaggcctccacacaggcacccaaggagcgtaaaagcgcgaaggcacctcagtgactcccacttggccatgacgcagtgtttctccagctctcgtttccaataagtcagcggtgtgcagtaagctctgctcttttctcccccagtgcctccctccccagcggtccctcaagcagcccag

SEQ ID NO: 437241 - DNA, 267 bp, Homo sapiens
cgtcccgcacactggcctccctgtctgggcccctctcgcatttcctcctggcagcttagacctcttccttgccttcctcgccctctggcctcctctccagcctgtgctcctcaggacgctgcttatgtacttctctcttctaggagcgaccccgaagccagagccagagccagagcaggtcataaaaaactacacggaagagctgaaagtgcccccagatgaggtttgtgtcttgggaccttggctgcctttgtttctgtttggaaa

SEQ ID NO: 437242 - DNA, 274 bp, Homo sapiens
caccccagcccaccagccctcccgcctcccgtctggcttccaaaagtcacggctcagttaagagattgaggaaaatgtccgtgaaaggagcgaccccgaagccagagccagagccagagcaggtcataaaaaactacacggaagagctgcttcgggcccccggtgctcggggcctggtgtggggcgagtaaagacttccccagcctggacgggcgtgggttctgggtcagcttcttttacctcaattttgtttgcaataaatgctctacagcca

SEQ ID NO: 437243 - DNA, 1688 bp, Homo sapiens
  misc_feature (68)..(68): n is a, c, g, or t
  misc_feature (117)..(117): n is a, c, g, or t
  misc_feature (1512)..(1512): n is a, c, g, or t
  misc_feature (1591)..(1592): n is a, c, g, or t
ctcgtacctgcttgattctgccctgcctcccaagttggattacagcatgagacaccaacccgtctgtnactctctctcagttccaggcagagggacctgggctccaccgtggtgggntttttttgtttgtttgtgtgttttgttttgttttgttttggagacggagtcttgctctgtcacccaaactggagggcagtggcaagatctcggctcactgcaacctccaccttctgggttcaagtgattctcctgcttcagcctcccgagtagctgggattataggcacctgccaacacgcccagctaatttttgtattcttagtagagatggggttttcccgtgttggccaggctggcctcaaattcctgacctcaagtgatcggcctcccagagtgctgggattacaggcctgagccactgcgcctggcctcggaattgactttgactgcacttccagcatttcagcacatgaaagcctctttttccaagactggcccacgtcagcccagcccactgttggcaagcatgacccgtgtttggtctcctccaggactgcatcatctgcatggagaagctgtccgcagcgtctggatacagcgatgtgactgacagcaaggcaatcgggcccctggctgtgggctgcctcaccaagtgcagccacgccttccacctgctgtgcctcctggccatgtactgcaacggcaataagggccctgagcaccccaatcccggaaagccgttcactgccagagggtttccccgccagtgctaccttccagacaacgcccagggccgcaagcctccaggggcttccagaacccggagacactggctgacattccggcctccccacagctgctgaccgatggccactacatgacgctgcccgtgtctccggaccagctgccctgtgacgaccccatggcgggcagcggtggtgcccccgtgctgcgggtgggccatgaccacggctgccaccagcagcccttctgcaacgcgcccctccctggccctggaccctatcgtacagaacctgctaaggccatcaaacctattgatcggaagtcagtccatcagatttgctctgggccagtggtactgagtctaagcactggatgaagaagatagtagaaaacagtctggatgctggtgccactaatgttgatctaaagcttaaggactatggaatggatctcattgaagtttcaggcaatggatgtggggtagaagaagaaaacttcgaaggcttaatgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagcttcttgagggctccccagccatgcttcctgtacngcctgcaaaactgactcctagaagtaccccaccccacccctgctccttggaggacaacgtgatcactgtattcagctcnntcaagaatggtccaggttcttctagatgatctgcacaaatggttcctctcctccttcctgatgtctgccattagcattggaataaagttcctgctg

SEQ ID NO: 437244 - DNA, 1214 bp, Homo sapiens
gagacagatgagtggctgcctcctgcacggatactaggatctaggttatccctgaggagaggatgatcttatacctaagaactactatatactcactctggacgttatatgctattgaagtttactgccccattgtcgtgaccattctgttcacagttgggccggctttacagcagttgtggtttgtatcaagatgggaactcaaacaagtcattcctcctaaggagctggtgtcttcatccagaagggacagtttgtgccagctctccagagagaaaagaacacggctggcagatccagctcctcgtatagtgccttcacccgggccaccttctcggcctccttctgcctgtaattttccttcaggatctggtactgttctggagtggcctgtagcagacactgaaccaccagccagctgcatttgttgtcctggaagtcattgccaactctgccagtcacactggggtccccaaagaagtcaaggtaatcatcctgaatctgaaagaactcttgaatctccagcaggatcttcttggcactggtgtgctccttcttgtcatccattcttgacatgtacatggctgcagctacaggaaggtagaaggagtagaaagctgtcttgtacttgacaacagatttgtgccttttttcggtgcatctgcgaagatccacattgccctggggggttgtgatgaggtcgagggtctgcccaatctcagtctgataagaattctgctggaagagctccatcaggttcaggtaatagggctgctcccggcaatacagcttcagcaggcagtagatacatgcttccagaaggatagcatcattgatggcatccaaacccatgcccagcttctgataccaggagatctgtccctggcaggtaagggatgaatccataatgtcatctgccaccaggaagaaagcttgcagcagttgcgcataccagcccacagtcggtgcccactggagactatcagcatccagtttcctcggctccaccagctcccggaacgctactagcaccatcaaacctcggtgatacttgcctccaatggcattgtactccaggacctccttgagccgggcagtagcatctcctgtctctgggtgccccatctcatcctcagtcagcaccctaacgatctgggagtagtgctgaacgaaatcctgctttgcttgggcataaatatctgatttctggtttc

SEQ ID NO: 437245 - DNA, 461 bp, Homo sapiens
gactaacctttggttttcctttgaaaacaggcaccacgcggactgtgcggagacacctgttcccccagcactcagcccctggccgaggtgtcgtctgggagtggctgagcgacgatggctcctggaccgcctatgaagccggcgtctgtgacgatctggagcagcaggtggccaggggcaaccagctcgtggacttggcccccctggggtacaactacactgtcaactacaccacccacacgcagaccaacaagacttccagcttctgctgcagcgtgcggcgccaagcagggccgccttacccagtgaccaccatcatcgctccgccgggccacacaggcgtcgcctgctcttgccaccagtgcctcagtggcagcagaactggccctgtgtcaggccgctaccgccactccatgaccaacctccctgcataccccgtcccccagcaccccccccacagg

SEQ ID NO: 437246 - DNA, 5209 bp, Homo sapiens
cacctccaaagctataccgttactcaccacaaagctttttaccagattctaccattcaaaaacaaaactttataccacatacatcattgcaagttaaaaatagtcagcttccaaattctgtattaactttaccatcaaggcagacctcagctgtaccatcacagcagtatgccacgcaaactgacaaaagacctcctcctcctccttacaactgtagatatggaagccagcctttgcaaagtactcagcatattactaaacacttgtctatggaagttcctcagagtcgagaaatgctgtcatctgaaataaggaccagctttcaacagcagtggcaaaaccctaatgaaaatgtcagcacaattggaaatttcactaacttgaaagtaaataccaacaacaaacagccttttaacagtcccattagatcttctgtggatggtgttcagactcttgctcaaactaatgaagagaaaataatggattcttgcaatccaacttcaaatcaagtactggacacaagtgttgcaaaagaaaagctagtaagggatattaaaacattagtagagataaaacagaagttttcagaacttgcaaggaaaattaaaatcaataaagatcttttgatggcagcaggttgtattaaaatgactaatacttcttatagtgaaccagctcagaattctaaattgtctctaaaacaaactgccaaaatccagtctggaccccagataactccagtaatgccagagaatgcagagagacaaacaccaacagtagtggaatctgcagaaacaaataagactcaatgtatgttgaattctgacattcaggaagtcaattgcagaaggtttaaccaagttgattctgttttaccaaatcctgtctattctgaaaagcggccaatgccagacccatctcatgatgtgaaagttctcacttcaaagacatcagctgttgagatgacccaggcagtattgaatactcagctttcatcagaaaatgttaccaaagttgagcaaaattcaccagcagtttgtgaaacaatttctgttcccaagtccatgtccactgaggaatataaatcaaaaattcaaaatgaaaatatgctacttctcgctttgctttcacaggcacgtaagactcagaagacagtattaaaagatgctaatcaaactattcaggattctaaaccagacagttgtgaaatgaatccaaatacccaaatgactggtaaccaactgaatttgaagaacatggaaactccaagtacttctaatgtaagtggcagggttttggacaactccttttgcagtggacaagaatcctcaacaaaaggaatgcctgctaaaagtgacagtagctgttccatggaagtgctagcaacctgtctttccctgtggaaaaagcaaccttcagatactgcaaaagaaaaggagtgtgataaactcagaacaaacacaacagcagttggaatttcaaagcctgctaacatccacgttaagagtccttgttcagttgtgggaaattcaaattctcagaataaaataagtaatccctcacagcagacagctttgtcgatggtaatgcacaattatgagtcttcaggtataaatataacaaagggaacagaacttcagatagctgtagtgtcaccgttagttctgtcagaggtcaaaacattgtctgtcaaaggaataacacctgcagtgttacctgaaacagtgtatcccgttattaaagaaggcagtgtttgtagtttacaaaatcaattggcagaaaatgcaaaggcaactgctgctttgaaagttgatgttagtggaccagtagcaagtacagcaacatcaaccaagatttttccactaactcagaaggaaaagcagaatgagtcaactaatggtaattcagaagtcacacctaatgtcaatcaaggaaagcataacaaattagagtcagctatccattctcctatgaacgatcagcaaatctcacaggagtcaaggaatagtactgttgtgagtagtgatacattacagattgacaatatttgttctctggttgaaggtgatacctcttacaattcccaaatagcaaagatattcagctctcttcccttgaaaatggttgagccacagaaaccttctctacccaatcagcaagggattggcagcagagaaccagaaaaacaattagataataccactgaaaataaagactttggttttcaaaaagataaacctgtacagtgcacagatgtttcacataaaatatgtgatcagtcaaagtcagagccacccttagagtcatcttttaacaatcttgaaacaaacagagttattctagagaaaagtagtttggagcatgccactgaaaaaagcacagctaacgatacgtgctcgtcagctgctattcaggaggatatttaccctcaggaaatagatgcatccagcaactatactccccaagatcctgcaagaaatgaaatccacagtgataaggcacctgtcttatacctacatgaccagctgtcagaacttctaaaagagtttccttatggcattgaggctgtgaatacacgtgaaggttctgtgggccagcaaactacataccagacctcagaagatcaaactgctgataaaaccagttctgactccaaagacccagcagatcaaatacaaattacaatattaagctcagagcaaatgaaagaaatatttcctgaacaggatgatcaaccctatgtagtagacaagttggcagaacctcagaaagaagagcccatcacagaagtagttagccagtgtgacctgcaggcacctgcagctggacaaagtcgtgattctgtgatactggactctgagaaagatgatatccactgctgtgcattgggctggctctccatggtttacgaaggagtaccccagtgtcagtgtaattccatcaagaactcatcttcagaggaagagaaacaaaaagagcagtgttctcctttggataccaacagttgtaaacaaggagagagaacttctgatagagatgtcactgttgttcaatttaagagccttgtaaataatccaaagactcctccagatgggaaaagtcattttcctgaactacaagacgacagtagaaaagatacacccaaaacaaaacataaaagcttaccaaggacagaacaagaattagttgctggtcagttttcatctaaatgtgataaactaaatcccttgcaaaatcacaaaagaaaaaaattgaggtttcacgaggtaacctttcactccagtaataaaatgacagcatcttatgaacaagcttctcaggaaacccgacagaagaaacatgtaacacagaactcacgtccactaaaaacaaaaacagcttttttgccaaataaagatgtgtataagaagcatagttctttgggacagtcattatcaccagaaaagataaaattgaaactcaaatcagttagcttcaaacaaaaacgaaagttagaccaagggaacgtattagatatggaagtaaagaaaaagaaacatgataaacaagaacagaaaggaagtgtgggagctacattcaaattaggtgactctttgtcaaacccaaacgaaagagccattgttaaagaaaagatggtatcaaatactaagtctgtagacacgaaagcgagttcatctaaatttagtagaattctaactcctaaggagtatttacaaaggcagaagcataaagaagctctgagtaataaagcatcgaagaaaatctgtgtgaaaaacgtgccatgtgattctgaacatatgagaccaagtaaacttgccgtgcaggttgaaagttgtgggaaatcaaatgagaaacacagcagcggcgtgcagacctctaaagaatcattaaatggcttgacaagccatggtaaaaacctcaaaatccaccattctcaggagtctaaaacatacaacattctaaggaatgttaaagaaaaagttggtgggaagcagcctgataaaatatggattgataagactaaattagacaaattaaccaatataagcaacgaagctcaattcagccaaatgcctccccaagtaaaggatcaaaagaaattatatctgaatagagttgggtttaaatgcactgaacgtgaaagcatttctctcaccaaattagaaagttcacccaggaagcttcataaagataagagacaggaaaataaacataagacctttttaccggtgaaaggtaacacagaaaaatcaaacatgctggagtttaaattatgtccagatatcttactaaagaatacaaactctgtggaagaacggaaggatgtaaagcctcatcctaggaaggagcaagcccctctgcaagtttcaggaataaaaagtacaaaagaagactggttaaaatttgttgctacaaagaaaaggacacagaaagacagccaagagagagataatgttaattcaagactctcgaagagaagcttcagtgcagatggatttgagatgctacaaaacccagtaaaagattcaaaagaaatgtttcaaacctacaaacagatgtacctggagaagagaagcagaagccttggtagcagtcctgtaaaataattacaagatgtggttttgtaattgccactgggaaatttctttccttttctgttcaaaatatttcgctgaaactaatgagaaatgccatgataaagatttctcagagtttggttcccactttcattgtatttcattgaaagtgcttaattaaaatggcttgagaactttgggtagccatgtgtaagaaatggatggtattcaccggggaaacaaggtatttgaatttctactttattgaaccagatttaccattattttaaaaggaatgcttatacaaatcaatttgaaattctacccatcttgagggaggaccgttcctcagttaaggacttgtttatttaaatgggactgtaaatatgttttggtttctaagctatattagcaaaatttatttttcaaaaatgcccactgtgatgtgaatgtcaaaatatattcttaagtgttttataactaattgtaaactttttttcagaagtcttattttatacttgtgaaactgaacacaattttgggacaacgtttaaacattacttttcatacttgaaataaacatttattttttaaaaaactaaaaaaaaagagaagaacaaacaacaaaacac

SEQ ID NO: 437247 - DNA, 5186 bp, Homo sapiens
cacctccaaagctataccgttactcaccacaaagctttttaccagattctaccattcaaaaacaaaactttataccacatacatcattgcaagttaaaaatagtcagcttccaaattctgtattaactttaccatcaaggcagacctcagctgtaccatcacagcagtatgccacgcaaactgacaaaagacctcctcctcctccttacaactgtagatatggaagccagcctttgcaaagtactcagcatattactaaacacttgtctatggaagttcctcagagtcgagaaatgctgtcatctgaaataaggaccagctttcaacagcagtggcaaaaccctaatgaaaatgtcagcacaattggaaatttcactaacttgaaagtaaataccaacaacaaacagccttttaacagtcccattagatcttctgtggatggtgttcagactcttgctcaaactaatgaagagaaaataatggattcttgcaatccaacttcaaatcaagtactggacacaagtgttgcaaaagaaaagctagtaagggatattaaaacattagtagagataaaacagaagttttcagaacttgcaaggaaaattaaaatcaataaagatcttttgatggcagcaggttgtattaaaatgactaatacttcttatagtgaaccagctcagaattctaaattgtctctaaaacaaactgccaaaatccagtctggaccccagataactccagtaatgccagagaatgcagagagacaaacaccaacagtagtggaatctgcagaaacaaataagactcaatgtatgttgaattctgacattcaggaagtcaattgcagaaggtttaaccaagttgattctgttttaccaaatcctgtctattctgaaaagcggccaatgccagacccatctcatgatgtgaaagttctcacttcaaagacatcagctgttgagatgacccaggcagtattgaatactcagctttcatcagaaaatgttaccaaagttgagcaaaattcaccagcagtttgtgaaacaatttctgttcccaagtccatgtccactgaggaatataaatcaaaaattcaaaatgaaaatatgctacttctcgctttgctttcacaggcacgtaagactcagaagacagtattaaaagatgctaatcaaactattcaggattctaaaccagacagttgtgaaatgaatccaaatacccaaatgactggtaaccaactgaatttgaagaacatggaaactccaagtacttctaatgtaagtggcagggttttggacaactccttttgcagtggacaagaatcctcaacaaaaggaatgcctgctaaaagtgacagtagctgttccatggaagtgctagcaacctgtctttccctgtggaaaaagcaaccttcagatactgcaaaagaaaaggagtgtgataaactcagaacaaacacaacagcagttggaatttcaaagcctgctaacatccacgttaagagtccttgttcagttgtgggaaattcaaattctcagaataaaataagtaatccctcacagcagacagctttgtcgatggtaatgcacaattatgagtcttcaggtataaatataacaaagggaacagaacttcagatagctgtagtgtcaccgttagttctgtcagaggtcaaaacattgtctgtcaaaggaataacacctgcagtgttacctgaaacagtgtatcccgttattaaagaaggcagtgtttgtagtttacaaaatcaattggcagaaaatgcaaaggcaactgctgctttgaaagttgatgttagtggaccagtagcaagtacagcaacatcaaccaagatttttccactaactcagaaggaaaagcagaatgagtcaactaatggtaattcagaagtcacacctaatgtcaatcaaggaaagcataacaaattagagtcagctatccattctcctatgaacgatcagcaaatctcacaggagtcaaggaatagtactgttgtgagtagtgatacattacagattgacaatatttgttctctggttgaaggtgatacctcttacaattcccaaatagcaaagatattcagctctcttcccttgaaaatggttgagccacagaaaccttctctacccaatcagcaagggattggcagcagagaaccagaaaaacaattagataataccactgaaaataaagactttggttttcaaaaagataaacctgtacagtgcacagatgtttcacataaaatatgtgatcagtcaaagtcagagccacccttagagtcatcttttaacaatcttgaaacaaacagagttattctagagaaaagtagtttggagcatgccactgaaaaaagcacagctaacgatacgtgctcgtcagctgctattcaggaggatatttaccctcaggaaatagatgcatccagcaactatactccccaagatcctgcaagaaatgaaatccacagtgataaggcacctgtcttatacctacatgaccagctgtcagaacttctaaaagagtttccttatggcattgaggctgtgaatacacgtgaaggttctgtgggccagcaaactacataccagacctcagaagatcaaactgctgataaaaccagttctgactccaaagacccagcagatcaaatacaaattacaatattaagctcagagcaaatgaaagaaatatttcctgaacaggatgatcaaccctatgtagtagacaagttggcagaacctcagaaagaagagcccatcacagaagtagttagccagtgtgacctgcaggcacctgcagctggacaaagtcgtgattctgtgatactggactctgagaaagatgatatccactgctgtgcattgggctggctctccatggtttacgaaggagtaccccagtgtcagtgtaattccatcaagaactcatcttcagaggaagagaaacaaaaagagcagtgttctcctttggataccaacagttgtaaacaaggagagagaacttctgatagagatgtcactgttgttcaatttaagagccttgtaaataatccaaagactcctccagatgggaaaagtcattttcctgaactacaagacgacagtagaaaagatacacccaaaacaaaacataaaagcttaccaaggacagaacaagaattagttgctggtcagttttcatctaaatgtgataaactaaatcccttgcaaaatcacaaaagaaaaaaattgaggtttcacgaggtaacctttcactccagtaataaaatgacagcatcttatgaacaagcttctcaggaaacccgacagaagaaacatgtaacacagaactcacgtccactaaaaacaaaaacagcttttttgccaaataaagatgtgtataagaagcatagttctttgggacagtcattatcaccagaaaagataaaattgaaactcaaatcagttagcttcaaacaaaaacgaaagttagaccaagggaacgtattagatatggaagtaaagaaaaagaaacatgataaacaagaacagaaaggaagtgtgggagctacattcaaattaggtgactctttgtcaaacccaaacgaaagagccattgttaaagaaaagatggtatcaaatactaagtctgtagacacgaaagcgagttcatctaaatttagtagaattctaactcctaaggagtatttacaaaggcagaagcataaagaagctctgagtaataaagcatcgaagaaaatctgtgtgaaaaacgtgccatgtgattctgaacatatgagaccaagtaaacttgccgtgcaggttgaaagttgtgggaaatcaaatgagaaacacagcagcggcgtgcagacctctaaagaatcattaaatggcttgacaagccatggtaaaaacctcaaaatccaccattctcaggagtctaaaacatacaacattctaaggaatgttaaagaaaaagttggtgggaagcagcctgataaaatatggattgataagactaaattagacaaattaaccaatataagcaacgaagctcaattcagccaaatgcctccccaagtaaaggatcaaaagaaattatatctgaatagagttgggtttaaatgcactgaacgtgaaagcatttctctcaccaaattagaaagttcacccaggaagcttcataaagataagagacaggaaaataaacataagacctttttaccggtgaaaggtaacacagaaaaatcaaacatgctggagtttaaattatgtccagatatcttactaaagaatacaaactctgtggaagaacggaaggatgtaaagcctcatcctaggaaggagcaagcccctctgcaagtttcaggaataaaaagtacaaaagaagactggttaaaatttgttgctacaaagaaaaggacacagaaagacagccaagagagagataatgttaattcaagactctcgaagagaagcttcagtgcagatggatttgagatgctacaaaacccagtaaaagattcaaaagaaatgtttcaaacctacaaacagatgtacctggagaagagaagcagaagccttggtagcagtcctgtaaaataattacaagatgtggttttgtaattgccactgggaaatttctttccttttctgttcaaaatatttcgctgaaactaatgagaaatgccatgataaagatttctcagagtttggttcccactttcattgtatttcattgaaagtgcttaattaaaatggcttgagaactttgggtagccatgtgtaagaaatggatggtattcaccggggaaacaaggtatttgaatttctactttattgaaccagatttaccattattttaaaaggaatgcttatacaaatcaatttgaaattctacccatcttgagggaggaccgttcctcagttaaggacttgtttatttaaatgggactgtaaatatgttttggtttctaagctatattagcaaaatttatttttcaaaaatgcccactgtgatgtgaatgtcaaaatatattcttaagtgttttataactaattgtaaactttttttcagaagtcttattttatacttgtgaaactgaacacaattttgggacaacgtttaaacattacttttcatacttgggtgggacgttatttttgtggggagtagaaggaaaa

SEQ ID NO: 437248 - DNA, 4542 bp, Homo sapiens
cacctccaaagctataccgttactcaccacaaagctttttaccagattctaccattcaaaaacaaaactttataccacatacatcattgcaagttaaaaatagtcagcttccaaattctgtattaactttaccatcaaggcagacctcagctgtaccatcacagcagtatgccacgcaaactgacaaaagacctcctcctcctccttacaactgtagatatggaagccagcctttgcaaagtactcagcatattactaaacacttgtctatggaagttcctcagagtcgagaaatgctgtcatctgaaataaggaccagctttcaacagcagtggcaaaaccctaatgaaaatgtcagcacaattggaaatttcactaacttgaaagtaaataccaacaacaaacagccttttaacagtcccattagatcttctgtggatggtgttcagactcttgctcaaactaatgaagagaaaataatggattcttgcaatccaacttcaaatcaagtactggacacaagtgttgcaaaagaaaagctagtaagggatattaaaacattagtagagataaaacagaagttttcagaacttgcaaggaaaattaaaatcaataaagatcttttgatggcagcaggttgtattaaaatgactaatacttcttatagtgaaccagctcagaattctaaattgtctctaaaacaaactgccaaaatccagtctggaccccagataactccagtaatgccagagaatgcagagagacaaacaccaacagtagtggaatctgcagaaacaaataagactcaatgtatgttgaattctgacattcaggaagtcaattgcagaaggtttaaccaagttgattctgttttaccaaatcctgtctattctgaaaagcggccaatgccagacccatctcatgatgtgaaagttctcacttcaaagacatcagctgttgagatgacccaggcagtattgaatactcagctttcatcagaaaatgttaccaaagttgagcaaaattcaccagcagtttgtgaaacaatttctgttcccaagtccatgtccactgaggaatataaatcaaaaattcaaaatgaaaatatgctacttctcgctttgctttcacaggcacgtaagactcagaagacagtattaaaagatgctaatcaaactattcaggattctaaaccagacagttgtgaaatgaatccaaatacccaaatgactggtaaccaactgaatttgaagaacatggaaactccaagtacttctaatgtaagtggcagggttttggacaactccttttgcagtggacaagaatcctcaacaaaaggaatgcctgctaaaagtgacagtagctgttccatggaagtgctagcaacctgtctttccctgtggaaaaagcaaccttcagatactgcaaaagaaaaggagtgtgataaactcagaacaaacacaacagcagttggaatttcaaagcctgctaacatccacgttaagagtccttgttcagttgtgggaaattcaaattctcagaataaaataagtaatccctcacagcagacagctttgtcgatggtaatgcacaattatgagtcttcaggtataaatataacaaagggaacagaacttcagatagctgtagtgtcaccgttagttctgtcagaggtcaaaacattgtctgtcaaaggaataacacctgcagtgttacctgaaacagtgtatcccgttattaaagaaggcagtgtttgtagtttacaaaatcaattggcagaaaatgcaaaggcaactgctgctttgaaagttgatgttagtggaccagtagcaagtacagcaacatcaaccaagatttttccactaactcagaaggaaaagcagaatgagtcaactaatggtaattcagaagtcacacctaatgtcaatcaaggaaagcataacaaattagagtcagctatccattctcctatgaacgatcagcaaatctcacaggagtcaaggaatagtactgttgtgagtagtgatacattacagattgacaatatttgttctctggttgaaggtgatacctcttacaattcccaaatagcaaagatattcagctctcttcccttgaaaatggttgagccacagaaaccttctctacccaatcagcaagggattggcagcagagaaccagaaaaacaattagataataccactgaaaataaagactttggttttcaaaaagataaacctgtacagtgcacagatgtttcacataaaatatgtgatcagtcaaagtcagagccacccttagagtcatcttttaacaatcttgaaacaaacagagttattctagagaaaagtagtttggagcatgccactgaaaaaagcacagctaacgatacgtgctcgtcagctgctattcaggaggatatttaccctcaggaaatagatgcatccagcaactatactccccaagatcctgcaagaaatgaaatccacagtgataaggcacctgtcttatacctacatgaccagctgtcagaacttctaaaagagtttccttatggcattgaggctgtgaatacacgtgaaggttctgtgggccagcaaactacataccagacctcagaagatcaaactgctgataaaaccagttctgactccaaagacccagcagatcaaatacaaattacaatattaagctcagagcaaatgaaagaaatatttcctgaacaggatgatcaaccctatgtagtagacaagttggcagaacctcagaaagaagagcccatcacagaagtagttagccagtgtgacctgcaggcacctgcagctggacaaagtcgtgattctgtgatactggactctgagaaagatgatatccactgctgtgcattgggctggctctccatggtttacgaaggagtaccccagtgtcagtgtaattccatcaagaactcatcttcagaggaagagaaacaaaaagagcagtgttctcctttggataccaacagttgtaaacaaggagagagaacttctgatagagatgtcactgttgttcaatttaagagccttgtaaataatccaaagactcctccagatgggaaaagtcattttcctgaactacaagacgacagtagaaaagatacacccaaaacaaaacataaaagcttaccaaggacagaacaagaattagttgctggtcagttttcatctaaatgtgataaactaaatcccttgcaaaatcacaaaagaaaaaaattgaggtttcacgaggtaacctttcactccagtaataaaatgacagcatcttatgaacaagcttctcaggaaacccgacagaagaaacatgtaacacagaactcacgtccactaaaaacaaaaacagcttttttgccaaataaagatgtgtataagaagcatagttctttgggacagtcattatcaccagaaaagataaaattgaaactcaaatcagttagcttcaaacaaaaacgaaagttagaccaagggaacgtattagatatggaagtaaagaaaaagaaacatgataaacaagaacagaaaggaagtgtgggagctacattcaaattaggtgactctttgtcaaacccaaacgaaagagccattgttaaagaaaagatggtatcaaatactaagtctgtagacacgaaagcgagttcatctaaatttagtagaattctaactcctaaggagtatttacaaaggcagaagcataaagaagctctgagtaataaagcatcgaagaaaatctgtgtgaaaaacgtgccatgtgattctgaacatatgagaccaagtaaacttgccgtgcaggttgaaagttgtgggaaatcaaatgagaaacacagcagcggcgtgcagacctctaaagaatcattaaatggcttgacaagccatggtaaaaacctcaaaatccaccattctcaggagtctaaaacatacaacattctaaggaatgttaaagaaaaagttggtgggaagcagcctgataaaatatggattgataagactaaattagacaaattaaccaatataagcaacgaagctcaattcagccaaatgcctccccaagtaaaggatcaaaagaaattatatctgaatagagttgggtttaaatgcactgaacgtgaaagcatttctctcaccaaattagaaagttcacccaggaagcttcataaagataagagacaggaaaataaacataagacctttttaccggtgaaaggtaacacagaaaaatcaaacatgctggagtttaaattatgtccagatatcttactaaagaatacaaactctgtggaagaacggaaggatgtaaagcctcatcctaggaaggagcaagcccctctgcaaggtccagtatgattttcttggtggtgtctacaatattgtaaagagtcgtaggtcaatatttgggctagcacctctcatgctgtcttgggctgctgggaaagactttaatgtgttatgccactacctagtatttgttttgcctggtaaaccaatgtttcattgggcaatatttgttttg

SEQ ID NO: 437249 - DNA, 4427 bp, Homo sapiens
cacctccaaagctataccgttactcaccacaaagctttttaccagattctaccattcaaaaacaaaactttataccacatacatcattgcaagttaaaaatagtcagcttccaaattctgtattaactttaccatcaaggcagacctcagctgtaccatcacagcagtatgccacgcaaactgacaaaagacctcctcctcctccttacaactgtagatatggaagccagcctttgcaaagtactcagcatattactaaacacttgtctatggaagttcctcagagtcgagaaatgctgtcatctgaaataaggaccagctttcaacagcagtggcaaaaccctaatgaaaatgtcagcacaattggaaatttcactaacttgaaagtaaataccaacaacaaacagccttttaacagtcccattagatcttctgtggatggtgttcagactcttgctcaaactaatgaagagaaaataatggattcttgcaatccaacttcaaatcaagtactggacacaagtgttgcaaaagaaaagctagtaagggatattaaaacattagtagagataaaacagaagttttcagaacttgcaaggaaaattaaaatcaataaagatcttttgatggcagcaggttgtattaaaatgactaatacttcttatagtgaaccagctcagaattctaaattgtctctaaaacaaactgccaaaatccagtctggaccccagataactccagtaatgccagagaatgcagagagacaaacaccaacagtagtggaatctgcagaaacaaataagactcaatgtatgttgaattctgacattcaggaagtcaattgcagaaggtttaaccaagttgattctgttttaccaaatcctgtctattctgaaaagcggccaatgccagacccatctcatgatgtgaaagttctcacttcaaagacatcagctgttgagatgacccaggcagtattgaatactcagctttcatcagaaaatgttaccaaagttgagcaaaattcaccagcagtttgtgaaacaatttctgttcccaagtccatgtccactgaggaatataaatcaaaaattcaaaatgaaaatatgctacttctcgctttgctttcacaggcacgtaagactcagaagacagtattaaaagatgctaatcaaactattcaggattctaaaccagacagttgtgaaatgaatccaaatacccaaatgactggtaaccaactgaatttgaagaacatggaaactccaagtacttctaatgtaagtggcagggttttggacaactccttttgcagtggacaagaatcctcaacaaaaggaatgcctgctaaaagtgacagtagctgttccatggaagtgctagcaacctgtctttccctgtggaaaaagcaaccttcagatactgcaaaagaaaaggagtgtgataaactcagaacaaacacaacagcagttggaatttcaaagcctgctaacatccacgttaagagtccttgttcagttgtgggaaattcaaattctcagaataaaataagtaatccctcacagcagacagctttgtcgatggtaatgcacaattatgagtcttcaggtataaatataacaaagggaacagaacttcagatagctgtagtgtcaccgttagttctgtcagaggtcaaaacattgtctgtcaaaggaataacacctgcagtgttacctgaaacagtgtatcccgttattaaagaaggcagtgtttgtagtttacaaaatcaattggcagaaaatgcaaaggcaactgctgctttgaaagttgatgttagtggaccagtagcaagtacagcaacatcaaccaagatttttccactaactcagaaggaaaagcagaatgagtcaactaatggtaattcagaagtcacacctaatgtcaatcaaggaaagcataacaaattagagtcagctatccattctcctatgaacgatcagcaaatctcacaggagtcaaggaatagtactgttgtgagtagtgatacattacagattgacaatatttgttctctggttgaaggtgatacctcttacaattcccaaatagcaaagatattcagctctcttcccttgaaaatggttgagccacagaaaccttctctacccaatcagcaagggattggcagcagagaaccagaaaaacaattagataataccactgaaaataaagactttggttttcaaaaagataaacctgtacagtgcacagatgtttcacataaaatatgtgatcagtcaaagtcagagccacccttagagtcatcttttaacaatcttgaaacaaacagagttattctagagaaaagtagtttggagcatgccactgaaaaaagcacagctaacgatacgtgctcgtcagctgctattcaggaggatatttaccctcaggaaatagatgcatccagcaactatactccccaagatcctgcaagaaatgaaatccacagtgataaggcacctgtcttatacctacatgaccagctgtcagaacttctaaaagagtttccttatggcattgaggctgtgaatacacgtgaaggttctgtgggccagcaaactacataccagacctcagaagatcaaactgctgataaaaccagttctgactccaaagacccagcagatcaaatacaaattacaatattaagctcagagcaaatgaaagaaatatttcctgaacaggatgatcaaccctatgtagtagacaagttggcagaacctcagaaagaagagcccatcacagaagtagttagccagtgtgacctgcaggcacctgcagctggacaaagtcgtgattctgtgatactggactctgagaaagatgatatccactgctgtgcattgggctggctctccatggtttacgaaggagtaccccagtgtcagtgtaattccatcaagaactcatcttcagaggaagagaaacaaaaagagcagtgttctcctttggataccaacagttgtaaacaaggagagagaacttctgatagagatgtcactgttgttcaatttaagagccttgtaaataatccaaagactcctccagatgggaaaagtcattttcctgaactacaagacgacagtagaaaagatacacccaaaacaaaacataaaagcttaccaaggacagaacaagaattagttgctggtcagttttcatctaaatgtgataaactaaatcccttgcaaaatcacaaaagaaaaaaattgaggtttcacgaggtaacctttcactccagtaataaaatgacagcatcttatgaacaagcttctcaggaaacccgacagaagaaacatgtaacacagaactcacgtccactaaaaacaaaaacagcttttttgccaaataaagatgtgtataagaagcatagttctttgggacagtcattatcaccagaaaagataaaattgaaactcaaatcagttagcttcaaacaaaaacgaaagttagaccaagggaacgtattagatatggaagtaaagaaaaagaaacatgataaacaagaacagaaaggaagtgtgggagctacattcaaattaggtgactctttgtcaaacccaaacgaaagagccattgttaaagaaaagatggtatcaaatactaagtctgtagacacgaaagcgagttcatctaaatttagtagaattctaactcctaaggagtatttacaaaggcagaagcataaagaagctctgagtaataaagcatcgaagaaaatctgtgtgaaaaacgtgccatgtgattctgaacatatgagaccaagtaaacttgccgtgcaggttgaaagttgtgggaaatcaaatgagaaacacagcagcggcgtgcagacctctaaagaatcattaaatggcttgacaagccatggtaaaaacctcaaaatccaccattctcaggagtctaaaacatacaacattctaaggaatgttaaagaaaaagttggtgggaagcagcctgataaaatatggattgataagactaaattagacaaattaaccaatataagcaacgaagctcaattcagccaaatgcctccccaagtaaaggatcaaaagaaattatatctgaatagagttgggtttaaatgcactgaacgtgaaagcatttctctcaccaaattagaaagttcacccaggaagcttcataaagataagagacaggaaaataaacataagacctttttaccggtgaaagccaaccacacaccaacataccaccctcgccaacaaaacacccccacgccctctccctctcacctccacgcccccggacaacacctcgtcacaccccaacaacatttctaaccttcacctctaccccccgtcccccccgaccacccctcaccgccctccccccgtcccccccgcccccccatcctcaccccc

SEQ ID NO: 437250 - DNA, 1162 bp, Homo sapiens
cgggaggccgccggttttctccccgcttgccggggtggtcctcttccctttgtcggaccaaagaagtaaacactgtgtggagagggactgacgtgtttggagggaaatgggaatgtacacgataattaaagagtaaagttgtgctcaacgctgtttacttctaattatttcctgattcacaaattaatttttgcaattcacaacttcaagaatacttggactattggattcaatccatagtaatctgcaaaagaagagaagcagaattatacctagaagtctactaatggacagttagtcacccacctacatgttgagtttcaggaataaaaagtacaaaagaagactggttaaaatttgttgctacaaagaaaaggacacagaaagacagccaagagagagataatgttaattcaagactctcgaagagaagcttcagtgcagatggatttgagatgctacaaaacccagtaaaagattcaaaagaaatgtttcaaacctacaaacagatgtacctggagaagagaagcagaagccttggtagcagtcctgtaaaataattacaagatgtggttttgtaattgccactgggaaatttctttccttttctgttcaaaatatttcgctgaaactaatgagaaatgccatgataaagatttctcagagtttggttcccactttcattgtatttcattgaaagtgcttaattaaaatggcttgagaactttgggtagccatgtgtaagaaatggatggtattcaccggggaaacaaggtatttgaatttctactttattgaaccagatttaccattattttaaaaggaatgcttatacaaatcaatttgaaattctacccatcttgagggaggaccgttcctcagttaaggacttgtttatttaaatgggactgtaaatatgttttggtttctaagctatattagcaaaatttatttttcaaaaatgcccactgtgatgtgaatgtcaaaatatattcttaagtgttttataactaattgtaaactttttttcagaagtcttattttatacttgtgaaactgaacacaattttgggacaacgtttaaacattacttttcatacttgaaataaacatttattttttaaaaaactaaaaaaaaagagaagaacaaacaacaaaacac

SEQ ID NO: 437251 - DNA, 994 bp, Homo sapiens
cgggaggccgccggttttctccccgcttgccggggtggtcctcttccctttgtcggaccaaagaagtaaacactgtgtggagagggactgacgtgtttggagggaaatgggaatgtacacgataattaaagagtaaagttgtgctcaacgtttcaggaataaaaagtacaaaagaagactggttaaaatttgttgctacaaagaaaaggacacagaaagacagccaagagagagataatgttaattcaagactctcgaagagaagcttcagtgcagatggatttgagatgctacaaaacccagtaaaagattcaaaagaaatgtttcaaacctacaaacagatgtacctggagaagagaagcagaagccttggtagcagtcctgtaaaataattacaagatgtggttttgtaattgccactgggaaatttctttccttttctgttcaaaatatttcgctgaaactaatgagaaatgccatgataaagatttctcagagtttggttcccactttcattgtatttcattgaaagtgcttaattaaaatggcttgagaactttgggtagccatgtgtaagaaatggatggtattcaccggggaaacaaggtatttgaatttctactttattgaaccagatttaccattattttaaaaggaatgcttatacaaatcaatttgaaattctacccatcttgagggaggaccgttcctcagttaaggacttgtttatttaaatgggactgtaaatatgttttggtttctaagctatattagcaaaatttatttttcaaaaatgcccactgtgatgtgaatgtcaaaatatattcttaagtgttttataactaattgtaaactttttttcagaagtcttattttatacttgtgaaactgaacacaattttgggacaacgtttaaacattacttttcatacttgaaataaacatttattttttaaaaaactaaaaaaaaagagaagaacaaacaacaaaacac

SEQ ID NO: 437252 - DNA, 1090 bp, Homo sapiens
tgtattaacctcttcagttcatgtgaggggaacataattacatagtaaagataaactcattttttaattgaggtaagcatttcaaatagaaatcatttttccagtcctttttttagagttgtgttacatgtggttatatctagggcctttcaaaatctattttcagcttacatgattttcctttgttatagtactaaaggagatgattagcaatatctagagttctgaaaatgaatatttaaatagtttcaggaataaaaagtacaaaagaagactggttaaaatttgttgctacaaagaaaaggacacagaaagacagccaagagagagataatgttaattcaagactctcgaagagaagcttcagtgcagatggatttgagatgctacaaaacccagtaaaagattcaaaagaaatgtttcaaacctacaaacagatgtacctggagaagagaagcagaagccttggtagcagtcctgtaaaataattacaagatgtggttttgtaattgccactgggaaatttctttccttttctgttcaaaatatttcgctgaaactaatgagaaatgccatgataaagatttctcagagtttggttcccactttcattgtatttcattgaaagtgcttaattaaaatggcttgagaactttgggtagccatgtgtaagaaatggatggtattcaccggggaaacaaggtatttgaatttctactttattgaaccagatttaccattattttaaaaggaatgcttatacaaatcaatttgaaattctacccatcttgagggaggaccgttcctcagttaaggacttgtttatttaaatgggactgtaaatatgttttggtttctaagctatattagcaaaatttatttttcaaaaatgcccactgtgatgtgaatgtcaaaatatattcttaagtgttttataactaattgtaaactttttttcagaagtcttattttatacttgtgaaactgaacacaattttgggacaacgtttaaacattacttttcatacttgaaataaacatttattttttaaaaaactaaaaaaaaagagaagaacaaacaacaaaacac

SEQ ID NO: 437253 - DNA, 927 bp, Homo sapiens
ataacttacaattctataagtgaagagctatggttctgaaacttttgcttaactccttgccttaattttttatccctccaatatatattttccctctgaattttgattatatattgatcacagctaacattgagaaataaagtaagtaaagtttttatttcccttagataatgttaattcaagactctcgaagagaagcttcagtgcagatggatttgagatgctacaaaacccagtaaaagattcaaaagaaatgtttcaaacctacaaacagatgtacctggagaagagaagcagaagccttggtagcagtcctgtaaaataattacaagatgtggttttgtaattgccactgggaaatttctttccttttctgttcaaaatatttcgctgaaactaatgagaaatgccatgataaagatttctcagagtttggttcccactttcattgtatttcattgaaagtgcttaattaaaatggcttgagaactttgggtagccatgtgtaagaaatggatggtattcaccggggaaacaaggtatttgaatttctactttattgaaccagatttaccattattttaaaaggaatgcttatacaaatcaatttgaaattctacccatcttgagggaggaccgttcctcagttaaggacttgtttatttaaatgggactgtaaatatgttttggtttctaagctatattagcaaaatttatttttcaaaaatgcccactgtgatgtgaatgtcaaaatatattcttaagtgttttataactaattgtaaactttttttcagaagtcttattttatacttgtgaaactgaacacaattttgggacaacgtttaaacattacttttcatacttgaaataaacatttattttttaaaaaactaaaaaaaaagagaagaacaaacaacaaaacac

SEQ ID NO: 437254 - DNA, 910 bp, Homo sapiens
cgggaggccgccggttttctccccgcttgccggggtggtcctcttccctttgtcggaccaaagaagtaaacactgtgtggagagggactgacgtgtttggagggaaatgggaatgtacacgataattaaagagtaaagttgtgctcaacgataatgttaattcaagactctcgaagagaagcttcagtgcagatggatttgagatgctacaaaacccagtaaaagattcaaaagaaatgtttcaaacctacaaacagatgtacctggagaagagaagcagaagccttggtagcagtcctgtaaaataattacaagatgtggttttgtaattgccactgggaaatttctttccttttctgttcaaaatatttcgctgaaactaatgagaaatgccatgataaagatttctcagagtttggttcccactttcattgtatttcattgaaagtgcttaattaaaatggcttgagaactttgggtagccatgtgtaagaaatggatggtattcaccggggaaacaaggtatttgaatttctactttattgaaccagatttaccattattttaaaaggaatgcttatacaaatcaatttgaaattctacccatcttgagggaggaccgttcctcagttaaggacttgtttatttaaatgggactgtaaatatgttttggtttctaagctatattagcaaaatttatttttcaaaaatgcccactgtgatgtgaatgtcaaaatatattcttaagtgttttataactaattgtaaactttttttcagaagtcttattttatacttgtgaaactgaacacaattttgggacaacgtttaaacattacttttcatacttgaaataaacatttattttttaaaaaactaaaaaaaaagagaagaacaaacaacaaaacac

SEQ ID NO: 437255 - DNA, 170 bp, Homo sapiens
tgttaatcttagtgagatctttaatatgaaagtccacatccataattatctttatgctttcttgcagctgtttacttctaattatttcctgattcacaaattaatttttgcaattcacaacttcaagaatacttggactattggattcaatccatagtaatctgcaaaag

SEQ ID NO: 437256 - DNA, 523 bp, Homo sapiens
  misc_feature (513)..(513): n is a, c, g, or t
cacctccaaagctataccgttactcaccacaaagctttttaccagattctaccattcaaaaacaaaactttataccacatacatcattgcaagttaaaaatagtcagcttccaaattctgtattaactttaccatcaaggcagacctcagctgtaccatcacagcagtatgccacgcaaactgacaaaagacctcctcctcctccttacaactgtagatatggaagccagcctttgcaaagtactcagcatattactaaacacttgtctatggaagttcctcagagtcgagaaatgctgtcatctgaaataaggaccagctttcaacagcagtggcaaaaccctaatgaaaatgtcagcacaattggaaatttcactaacttgaaagtaaataccaacaacaaacagccttttaacagtcccattagatcttctgtggatggtgttcagattggtggtggggctaatcactaaaaaataaaccctcccccatccacttagagtctgaactggnccgagtgttc

SEQ ID NO: 437257 - DNA, 5155 bp, Homo sapiens
cacctccaaagctataccgttactcaccacaaagctttttaccagattctaccattcaaaaacaaaactttataccacatacatcattgcaagttaaaaatagtcagcttccaaattctgtattaactttaccatcaaggcagacctcagctgtaccatcacagcagtatgccacgcaaactgacaaaagacctcctcctcctccttacaactgtagatatggaagccagcctttgcaaagtactcagcatattactaaacacttgtctatggaagttcctcagagtcgagaaatgctgtcatctgaaataaggaccagctttcaacagcagtggcaaaaccctaatgaaaatgtcagcacaattggaaatttcactaacttgaaagtaaataccaacaacaaacagccttttaacagtcccattagatcttctgtggatggtgttcagactcttgctcaaactaatgaagagaaaataatggattcttgcaatccaacttcaaatcaagtactggacacaagtgttgcaaaagaaaagctagtaagggatattaaaacattagtagagataaaacagaagttttcagaacttgcaaggaaaattaaaatcaataaagatcttttgatggcagcaggttgtattaaaatgactaatacttcttatagtgaaccagctcagaattctaaattgtctctaaaacaaactgccaaaatccagtctggaccccagataactccagtaatgccagagaatgcagagagacaaacaccaacagtagtggaatctgcagaaacaaataagactcaatgtatgttgaattctgacattcaggaagtcaattgcagaaggtttaaccaagttgattctgttttaccaaatcctgtctattctgaaaagcggccaatgccagacccatctcatgatgtgaaagttctcacttcaaagacatcagctgttgagatgacccaggcagtattgaatactcagctttcatcagaaaatgttaccaaagttgagcaaaattcaccagcagtttgtgaaacaatttctgttcccaagtccatgtccactgaggaatataaatcaaaaattcaaaatgaaaatatgctacttctcgctttgctttcacaggcacgtaagactcagaagacagtattaaaagatgctaatcaaactattcaggattctaaaccagacagttgtgaaatgaatccaaatacccaaatgactggtaaccaactgaatttgaagaacatggaaactccaagtacttctaatgtaagtggcagggttttggacaactccttttgcagtggacaagaatcctcaacaaaaggaatgcctgctaaaagtgacagtagctgttccatggaagtgctagcaacctgtctttccctgtggaaaaagcaaccttcagatactgcaaaagaaaaggagtgtgataaactcagaacaaacacaacagcagttggaatttcaaagcctgctaacatccacgttaagagtccttgttcagttgtgggaaattcaaattctcagaataaaataagtaatccctcacagcagacagctttgtcgatggtaatgcacaattatgagtcttcaggtataaatataacaaagggaacagaacttcagatagctgtagtgtcaccgttagttctgtcagaggtcaaaacattgtctgtcaaaggaataacacctgcagtgttacctgaaacagtgtatcccgttattaaagaaggcagtgtttgtagtttacaaaatcaattggcagaaaatgcaaaggcaactgctgctttgaaagttgatgttagtggaccagtagcaagtacagcaacatcaaccaagatttttccactaactcagaaggaaaagcagaatgagtcaactaatggtaattcagaagtcacacctaatgtcaatcaaggaaagcataacaaattagagtcagctatccattctcctatgaacgatcagcaaatctcacaggagtcaaggaatagtactgttgtgagtagtgatacattacagattgacaatatttgttctctggttgaaggtgatacctcttacaattcccaaatagcaaagatattcagctctcttcccttgaaaatggttgagccacagaaaccttctctacccaatcagcaagggattggcagcagagaaccagaaaaacaattagataataccactgaaaataaagactttggttttcaaaaagataaacctgtacagtgcacagatgtttcacataaaatatgtgatcagtcaaagtcagagccacccttagagtcatcttttaacaatcttgaaacaaacagagttattctagagaaaagtagtttggagcatgccactgaaaaaagcacagctaacgatacgtgctcgtcagctgctattcaggaggatatttaccctcaggaaatagatgcatccagcaactatactccccaagatcctgcaagaaatgaaatccacagtgataaggcacctgtcttatacctacatgaccagctgtcagaacttctaaaagagtttccttatggcattgaggctgtgaatacacgtgaaggttctgtgggccagcaaactacataccagacctcagaagatcaaactgctgataaaaccagttctgactccaaagacccagcagatcaaatacaaattacaatattaagctcagagcaaatgaaagaaatatttcctgaacaggatgatcaaccctatgtagtagacaagttggcagaacctcagaaagaagagcccatcacagaagtagttagccagtgtgacctgcaggcacctgcagctggacaaagtcgtgattctgtgatactggactctgagaaagatgatatccactgctgtgcattgggctggctctccatggtttacgaaggagtaccccagtgtcagtgtaattccatcaagaactcatcttcagaggaagagaaacaaaaagagcagtgttctcctttggataccaacagttgtaaacaaggagagagaacttctgatagagatgtcactgttgttcaatttaagagccttgtaaataatccaaagactcctccagatgggaaaagtcattttcctgaactacaagacgacagtagaaaagatacacccaaaacaaaacataaaagcttaccaaggacagaacaagaattagttgctggtcagttttcatctaaatgtgataaactaaatcccttgcaaaatcacaaaagaaaaaaattgaggtttcacgaggtaacctttcactccagtaataaaatgacagcatcttatgaacaagcttctcaggaaacccgacagaagaaacatgtaacacagaactcacgtccactaaaaacaaaaacagcttttttgccaaataaagatgtgtataagaagcatagttctttgggacagtcattatcaccagaaaagataaaattgaaactcaaatcagttagcttcaaacaaaaacgaaagttagaccaagggaacgtattagatatggaagtaaagaaaaagaaacatgataaacaagaacagaaaggaagtgtgggagctacattcaaattaggtgactctttgtcaaacccaaacgaaagagccattgttaaagaaaagatggtatcaaatactaagtctgtagacacgaaagcgagttcatctaaatttagtagaattctaactcctaaggagtatttacaaaggcagaagcataaagaagctctgagtaataaagcatcgaagaaaatctgtgtgaaaaacgtgccatgtgattctgaacatatgagaccaagtaaacttgccgtgcaggttgaaagttgtgggaaatcaaatgagaaacacagcagcggcgtgcagacctctaaagaatcattaaatggcttgacaagccatggtaaaaacctcaaaatccaccattctcaggagtctaaaacatacaacattctaaggaatgttaaagaaaaagttggtgggaagcagcctgataaaatatggattgataagactaaattagacaaattaaccaatataagcaacgaagctcaattcagccaaatgcctccccaagtaaaggatcaaaagaaattatatctgaatagagttgggtttaaatgcactgaacgtgaaagcatttctctcaccaaattagaaagttcacccaggaagcttcataaagataagagacaggaaaataaacataagacctttttaccggtgaaaggtaacacagaaaaatcaaacatgctggagtttaaattatgtccagatatcttactaaagaatacaaactctgtggaagaacggaaggatgtaaagcctcatcctaggaaggagcaagcccctctgcaagtttcaggaataaaaagtacaaaagaagactggttaaaatttgttgctacaaagaaaaggacacagaaagacagccaagagagagataatgttaattcaagactctcgaagagaagcttcagtgcagatggatttgagatgctacaaaacccagtaaaagattcaaaagaaatgtttcaaacctacaaacagatgtacctggagaagagaagcagaagccttggtagcagtcctgtaaaataattacaagatgtggttttgtaattgccactgggaaatttctttccttttctagtttggttcccactttcattgtatttcattgaaagtgcttaattaaaatggcttgagaactttgggtagccatgtgtaagaaatggatggtattcaccggggaaacaaggtatttgaatttctactttattgaaccagatttaccattattttaaaaggaatgcttatacaaatcaatttgaaattctacccatcttgagggaggaccgttcctcagttaaggacttgtttatttaaatgggactgtaaatatgttttggtttctaagctatattagcaaaatttatttttcaaaaatgcccactgtgatgtgaatgtcaaaatatattcttaagtgttttataactaattgtaaactttttttcagaagtcttattttatacttgtgaaactgaacacaattttgggacaacgtttaaacattacttttcatacttgaaataaacatttattttttaaaaaactaaaaaaaaagagaagaacaaacaacaaaacac

SEQ ID NO: 437258 - DNA, 4869 bp, Homo sapiens
cacctccaaagctataccgttactcaccacaaagctttttaccagattctaccattcaaaaacaaaactttataccacatacatcattgcaagttaaaaatagtcagcttccaaattctgtattaactttaccatcaaggcagacctcagctgtaccatcacagcagtatgccacgcaaactgacaaaagacctcctcctcctccttacaactgtagatatggaagccagcctttgcaaagtactcagcatattactaaacacttgtctatggaagttcctcagagtcgagaaatgctgtcatctgaaataaggaccagctttcaacagcagtggcaaaaccctaatgaaaatgtcagcacaattggaaatttcactaacttgaaagtaaataccaacaacaaacagccttttaacagtcccattagatcttctgtggatggtgttcagactcttgctcaaactaatgaagagaaaataatggattcttgcaatccaacttcaaatcaagtactggacacaagtgttgcaaaagaaaagctagtaagggatattaaaacattagtagagataaaacagaagttttcagaacttgcaaggaaaattaaaatcaataaagatcttttgatggcagcaggttgtattaaaatgactaatacttcttatagtgaaccagctcagaattctaaattgtctctaaaacaaactgccaaaatccagtctggaccccagataactccagtaatgccagagaatgcagagagacaaacaccaacagtagtggaatctgcagaaacaaataagactcaatgtatgttgaattctgacattcaggaagtcaattgcagaaggtttaaccaagttgattctgttttaccaaatcctgtctattctgaaaagcggccaatgccagacccatctcatgatgtgaaagttctcacttcaaagacatcagctgttgagatgacccaggcagtattgaatactcagctttcatcagaaaatgttaccaaagttgagcaaaattcaccagcagtttgtgaaacaatttctgttcccaagtccatgtccactgaggaatataaatcaaaaattcaaaatgaaaatatgctacttctcgctttgctttcacaggcacgtaagactcagaagacagtattaaaagatgctaatcaaactattcaggattctaaaccagacagttgtgaaatgaatccaaatacccaaatgactggtaaccaactgaatttgaagaacatggaaactccaagtacttctaatgtaagtggcagggttttggacaactccttttgcagtggacaagaatcctcaacaaaaggaatgcctgctaaaagtgacagtagctgttccatggaagtgctagcaacctgtctttccctgtggaaaaagcaaccttcagatactgcaaaagaaaaggagtgtgataaactcagaacaaacacaacagcagttggaatttcaaagcctgctaacatccacgttaagagtccttgttcagttgtgggaaattcaaattctcagaataaaataagtaatccctcacagcagacagctttgtcgatggtaatgcacaattatgagtcttcaggtataaatataacaaagggaacagaacttcagatagctgtagtgtcaccgttagttctgtcagaggtcaaaacattgtctgtcaaaggaataacacctgcagtgttacctgaaacagtgtatcccgttattaaagaaggcagtgtttgtagtttacaaaatcaattggcagaaaatgcaaaggcaactgctgctttgaaagttgatgttagtggaccagtagcaagtacagcaacatcaaccaagatttttccactaactcagaaggaaaagcagaatgagtcaactaatggtaattcagaagtcacacctaatgtcaatcaaggaaagcataacaaattagagtcagctatccattctcctatgaacgatcagcaaatctcacaggagtcaaggaatagtactgttgtgagtagtgatacattacagattgacaatatttgttctctggttgaaggtgatacctcttacaattcccaaatagcaaagatattcagctctcttcccttgaaaatggttgagccacagaaaccttctctacccaatcagcaagggattggcagcagagaaccagaaaaacaattagataataccactgaaaataaagactttggttttcaaaaagataaacctgtacagtgcacagatgtttcacataaaatatgtgatcagtcaaagtcagagccacccttagagtcatcttttaacaatcttgaaacaaacagagttattctagagaaaagtagtttggagcatgccactgaaaaaagcacagctaacgatacgtgctcgtcagctgctattcaggaggatatttaccctcaggaaatagatgcatccagcaactatactccccaagatcctgcaagaaatgaaatccacagtgataaggcacctgtcttatacctacatgaccagctgtcagaacttctaaaagagtttccttatggcattgaggctgtgaatacacgtgaaggttctgtgggccagcaaactacataccagacctcagaagatcaaactgctgataaaaccagttctgactccaaagacccagcagatcaaatacaaattacaatattaagctcagagcaaatgaaagaaatatttcctgaacaggatgatcaaccctatgtagtagacaagttggcagaacctcagaaagaagagcccatcacagaagtagttagccagtgtgacctgcaggcacctgcagctggacaaagtcgtgattctgtgatactggactctgagaaagatgatatccactgctgtgcattgggctggctctccatggtttacgaaggagtaccccagtgtcagtgtaattccatcaagaactcatcttcagaggaagagaaacaaaaagagcagtgttctcctttggataccaacagttgtaaacaaggagagagaacttctgatagagatgtcactgttgttcaatttaagagccttgtaaataatccaaagactcctccagatgggaaaagtcattttcctgaactacaagacgacagtagaaaagatacacccaaaacaaaacataaaagcttaccaaggacagaacaagaattagttgctggtcagttttcatctaaatgtgataaactaaatcccttgcaaaatcacaaaagaaaaaaattgaggtttcacgaggtaacctttcactccagtaataaaatgacagcatcttatgaacaagcttctcaggaaacccgacagaagaaacatgtaacacagaactcacgtccactaaaaacaaaaacagcttttttgccaaataaagatgtgtataagaagcatagttctttgggacagtcattatcaccagaaaagataaaattgaaactcaaatcagttagcttcaaacaaaaacgaaagttagaccaagggaacgtattagatatggaagtaaagaaaaagaaacatgataaacaagaacagaaaggaagtgtgggagctacattcaaattaggtgactctttgtcaaacccaaacgaaagagccattgttaaagaaaagatggtatcaaatactaagtctgtagacacgaaagcgagttcatctaaatttagtagaattctaactcctaaggagtatttacaaaggcagaagcataaagaagctctgagtaataaagcatcgaagaaaatctgtgtgaaaaacgtgccatgtgattctgaacatatgagaccaagtaaacttgccgtgcaggttgaaagttgtgggaaatcaaatgagaaacacagcagcggcgtgcagacctctaaagaatcattaaatggcttgacaagccatggtaaaaacctcaaaatccaccattctcaggagtctaaaacatacaacattctaaggaatgttaaagaaaaagttggtgggaagcagcctgataaaatatggattgataagactaaattagacaaattaaccaatataagcaacgaagctcaattcagccaaatgcctccccaagtaaaggatcaaaagaaattatatctgaatagagttgggtttaaatgcactgaacgtgaaagcatttctctcaccaaattagaaagttcacccaggaagcttcataaagataagagacaggaaaataaacataagacctttttaccggtgaaaggtaacacagaaaaatcaaacatgctggagtttaaattatgtccagatatcttactaaagaatacaaactctgtggaagaacggaaggatgtaaagcctcatcctaggaaggagcaagcccctctgcaagtttcaggaataaaaagtacaaaagaagactggttaaaatttgttgctacaaagaaaaggacacagaaagacagccaagagagagataatgttaattcaagactctcgaagagaagcttcagtgcagatggatttgagatgctacaaaacccagtaaaagattcaaaagaaatgtttcaaacctacaaacagatgtacctggagaagagaagcagaagccttgacggagttttgctctgcctcccatacaggctggagtgccgtggcgcggtcttagctcactgcagcctctgcctcccgggctcgggctattctcctgcctcagcctcccgagtggctgcgattaacaggaaagttggccgggcatggtgggaggcacctgtagtcccagctactcgggaggctgaggcaggagaatggcgtgaacccgggaggcagagcttgcagtgcgccgagatcgcgccactgcactccagcctgggcgacagagccagactccttctca

SEQ ID NO: 437259 - DNA, 2588 bp, Homo sapiens
cacctccaaagctataccgttactcaccacaaagctttttaccagattctaccattcaaaaacaaaactttataccacatacatcattgcaagttaaaaatagtcagcttccaaattctgtattaactttaccatcaaggcagacctcagctgtaccatcacagcagtatgccacgcaaactgacaaaagacctcctcctcctccttacaactgtagatatggaagccagcctttgcaaagtactcagcatattactaaacacttgtctatggaagttcctcagagtcgagaaatgctgtcatctgaaataaggaccagctttcaacagcagtggcaaaaccctaatgaaaatgtcagcacaattggaaatttcactaacttgaaagtaaataccaacaacaaacagccttttaacagtcccattagatcttctgtggatggtgttcagactcttgctcaaactaatgaagagaaaataatggattcttgcaatccaacttcaaatcaagtactggacacaagtgttgcaaaagaaaagctagtaagggatattaaaacattagtagagataaaacagaagttttcagaacttgcaaggaaaattaaaatcaataaagatcttttgatggcagcaggttgtattaaaatgactaatacttcttatagtgaaccagctcagaattctaaattgtctctaaaacaaactgccaaaatccagtctggaccccagataactccagtaatgccagagaatgcagagagacaaacaccaacagtagtggaatctgcagaaacaaataagactcaatgtatgttgaattctgacattcaggaagtcaattgcagaaggtttaaccaagttgattctgttttaccaaatcctgtctattctgaaaagcggccaatgccagacccatctcatgatgtgaaagttctcacttcaaagacatcagctgttgagatgacccaggcagtattgaatactcagctttcatcagaaaatgttaccaaagttgagcaaaattcaccagcagtttgtgaaacaatttctgttcccaagtccatgtccactgaggaatataaatcaaaaattcaaaatgaaaatatgctacttctcgctttgctttcacaggcacgtaagactcagaagacagtattaaaagatgctaatcaaactattcaggattctaaaccagacagttgtgaaatgaatccaaatacccaaatgactggtaaccaactgaatttgaagaacatggaaactccaagtacttctaatgtaagtggcagggttttggacaactccttttgcagtggacaagaatcctcaacaaaaggaatgcctgctaaaagtgacagtagctgttccatggaagtgctagcaacctgtctttccctgtggaaaaagcaaccttcagatactgcaaaagaaaaggagtgtgataaactcagaacaaacacaacagcagttggaatttcaaagcctgctaacatccacgttaagagtccttgttcagttgtgggaaattcaaattctcagaataaaataagtaatccctcacagcagacagctttgtcgatggtaatgcacaattatgagtcttcaggtataaatataacaaagggaacagaacttcagatagctgtagtgtcaccgttagttctgtcagaggtcaaaacattgtctgtcaaaggaataacacctgcagtgttacctgaaacagtgtatcccgttattaaagaaggcagtgtttgtagtttacaaaatcaattggcagaaaatgcaaaggcaactgctgctttgaaagttgatgttagtggaccagtagcaagtacagcaacatcaaccaagatttttccactaactcagaaggaaaagcagaatgagtcaactaatggtaattcagaagtcacacctaatgtcaatcaaggaaagcataacaaattagagtcagctatccattctcctatgaacgatcagcaaatctcacaggagtcaaggaatagtactgttgtgagtagtgatacattacagattgacaatatttgttctctggttgaaggtgatacctcttacaattcccaaatagcaaagatattcagctctcttcccttgaaaatggttgagccacagaaaccttctctacccaatcagcaagggattggcagcagagaaccagaaaaacaattagataataccactgaaaataaagactttggttttcaaaaagataaacctgtacagtgcacagatgtttcacataaaatatgtgatcagtcaaagtcagagccacccttagagtcatcttttaacaatcttgaaacaaacagagttattctagagaaaagtagtttggagcatgccactgaaaaaagcacagctaacgatacgtgctcgtcagctgctattcaggaggatatttaccctcaggaaatagatgcatccagcaactatactccccaagatcctgcaagaaatgaaatccacagtgataaggcacctgtcttatacctacatgaccagctgtcagaacttctaaaagagtttccatgcactctgacttcttctaatctttctgtcctgtca

SEQ ID NO: 437260 - DNA, 611 bp, Homo sapiens
gaaactcttcagtacaagcttctgaaatgacagtacctcaaaagccttctgtgtgccaccgaccttgtaaaattgaaccagttgggattcaaaggtcatataagcctgaacacacaggcccagcattacataacttatgtgggcaaaagccaactattagagacccttactgtagaacacaaaacttggaaatccgtgaagtgttttcattggcagttagcgattacccccagagaattctgggaggaaatgccccacagaagcctagctcagcagaaggaaattgtttgtccattgcaatggagactggagatgctgaggatgaatatgccagagaggaagagctggcatcgatgagagcacagataccaagctattcgagattttatgaaagtggcagttcccttcgagctgagaaccaaagtacaaccttgcccggaccaggaagaaatatgccaaattcacaaatggtgaatattagagatatgtcagacaatgtactgtatcaaaacagaaactaccatttgacaccacggacctcattacatacagcatctagtacaatgtacagtaataccaatccattacggagtaatttttctcctcatttt

SEQ ID NO: 437261 - DNA, 2034 bp, Homo sapiens
gcggccgccacgcagtcccacaatgccccgctcgcaccaccctgagggcggagagaaaggaccgctgccggggatagggcttccgccgagagcgccgagaagtgcgcacgcgcactgaccccgcgggccctagcaaccagagcagtgacagtagcaaccgccggaatggcgaaagcaacaacaatcaaagaagccttagcgagatgggaagagaaaactggccagaggccatctgaagccaaagagataaaactttatgcccagattccccctatagagaagatggatgcatccttgtccatgcttgctaattgcgagaagctttcactgtctacaaactgcattgaaaaaattgccaacctgaatggcttaaaaaacttgaggatattatctttaggaagaaacaacataaagaacttaaatggactggaggcagtaggggacacattagaagaactgtggatctcctacaattttattgagaagttgaaagggatccacataatgaagaaattgaagattctctacatgtctaataacctggtaaaagactgggctgagtttgtgaagctggcagaactgccatgcctcgaagacctggtgtttgtaggcaatcccttggaagagaaacattctgctgagaataactggattgaagaagcaaccaagagagtgcccaaactgaaaaagctggatggtactccagtaattaaaggggatgaggaagaagacaactaatgccacgctttccactgtgtgttaacttatttaaatgtcataagaacaatagataaattttatataattgtctattttaaagattctgtatgggacaaaagtttcttaagataaaacagatcactcattctcatctttttttttcctttaacttattcagtgtttctccccaaaactggtaatgccaaccttatatatcctatttctctttttagaaaccacaaattttcgatttttgtcttcagtctcagttacgtactgtgtagccccatctactaaaacaaaacctttgtagaccagtcatttttaataacaaaggaacaaatgtttttttcagtttgttcattttttttaggttagacattttaaaagatgtacatttgaaaattcagaacatttttcctgaaggtctgtctctgtacaattcagaagcacatgcctttagctcagaaggcagcatggtgatgggaagagttcctcttagaaatacagcaggtccggaaccaagactccaaagttccattggaaaagatatggtgaaaaaaggaaaaagtagtatctcagagaccttctagtctatattatacttatttgtttttccaaaaatgtgcacattgtcaactggaatttaggttgtttttatatgcatggccacttgagtcattgtgtacagtcattctgtgatctcagttagtggttaaaatgactgtcatgatcatttctttgactgataatgtggcaatgttactcatgtggacctcgccttaagcacacattttggttttatagttccttatgtgtttaaagcattagttatatttgaattcctagactaaatgctggccattgatgtatgtcaaaatttaccctaattatttggtctggtgaccctcattgttgggaaaagtgactaccatggttataagtaagggtataatgaaacttagtatttcaaaatatattttttgagaagttctaagttaaacagctcttaaaatgtattatgtacgtggttgtggagggaagggagatgtttcattatgagatcccaggcaaatggcaatatgtttgaggattgtctcctacataaagcagtgtaggtgatttaacctcaaaattgcaaagcaatagttagatgcagaggttagaatttatcatgtaaacaaaaaatccttcaggaaaatgtaagacattgtagtcagtaagcagatgaggtcataggaggccatggctggatcactattagattgcagaaaagaagtcaggggccctctgccaaattgtgcctaaagtccc

SEQ ID NO: 437262 - DNA, 2574 bp, Homo sapiens
gcggccgccacgcagtcccacaatgccccgctcgcaccaccctgagggcggagagaaaggaccgctgccggggatagggcttccgccgagagcgccgagaagtgcgcacgcgcactgaccccgcgggccctagcaaccagagcagtgacagtagcaaccgccggaatggaagctttcactgtctacaaactgcattgaaaaaattgccaacctgaatggcttaaaaaacttgaggatattatctttaggaagaaacaacataaagaacttaaatggactggaggcagtaggggacacattagaagaactgtggatctcctacaattttattgagaagttgaaagggatccacataatgaagaaattgaagattctctacatgtctaataacctggtaaaagactgggctgagtttgtgaagctggcagaactgccatgcctcgaagacctggtgtttgtaggcaatcccttggaagagaaacattctgctgagaataactggattgaagaagcaaccaagagagtgcccaaactgaaaaagctggatggtactccagtaattaaaggggatgaggaagaagacaactaatgccacgctttccactgtgtgttaacttatttaaatgtcataagaacaatagataaattttatataattgtctattttaaagattctgtatgggacaaaagtttcttaagataaaacagatcactcattctcatctttttttttcctttaacttattcagtgtttctccccaaaactggtaatgccaaccttatatatcctatttctctttttagaaaccacaaattttcgatttttgtcttcagtctcagttacgtactgtgtagccccatctatcgggaggctgaggcaggagaattgcttgaacccgggaggcagaggcttcagtgagccgaaatagtgtgactgtactccagcctgggtgacagagtaagtctccgtctcaaaaagaaaaaaaaaatgtggttcttttgtggaaagaggaatttgaacttgaataaacacttcttttgacaccttttaccagtggtctgaagcagaataaggaagaataagaaatgaatcttgactgttgacttattctgagaattggtgatgtgtaaagagagttggaatcttctacctgggtttttctcagggctaaatggaaaagcacagggcccagaaaggttggagttaatcattcacttaaaagcattaggaggaagtgtcaaagcatcagtcatgaatagattatgtctctctgactacagtcagaccatcaattcactaagaccttatactctgtaagtgttggtaaaggaagaaaactgctaaattgcatgttaccctttactagaaattcattcctttggcacagattttatttatttggggctgtttaatgtgtctgtaaatcatgaaatataaaagcaagattcagtgtagcagagttggtgcttcttctgacaagctaacttgaccatatttctttatctgtgctctaacatgtgtcatattgttttctttttgtaaaccataaaatgggtgaacttccaaaaatcaagggtcatgttttaaaatcatggaacttttagaaataccatatctgtatctctattcctgcattttataaatctgtaaaggaagaaaactgaaaggaagaactagactgagtcttacctttctctgacctaagataaactgataaaactttttacttgatatttggagaagtcattaactggattctagttaatttcccatattgggcagtttagaggagacccagccaaccaaattatgatctagcaaatttaacataggggaagagggatagtaaactatttttcagtagatttgcactttaaacttaggaactggatgttggtggaaaggacttccatagggcagatgggtaaatatctagcctgcacttggatgttagagaatcaaacctcacccttgctcgttctaaacccacatgagtagttaactgtcttttgacataatcagagtcaggatttccctttttccctacttgagtcgtcttccatgtctgttacatccaagatcatccctctgggggatgtgtcaagtagttctcctactcagaatagaagctttgcgaattatcattcccacctctagattttaaatgaatgtagagttgtctaacattatatgggtgggaggctctttgcctctgtgatcagtagggtacctgcctctgaggtgctactgcctggagggatcactcccatcaaaagactggtgagttggaagctaagagcacatgcgcatagccagctcctctcccaggctggcagtcatgattacgagcatcattccagaatctttggcttctagaaccaactccattctgaagaacattttaacatctatgaataccttggtaataatcttttatacacaggagttttgtagcatgactttatgactaaacttattgtgaattaagttatttagaaatgttgagtttctgaatgttattttgtgatttgtttcaaaatagtaataaattgtgttattttgtaaaaaaaaaa

SEQ ID NO: 437263 - DNA, 2682 bp, Homo sapiens
aaatgtatttttctcataggaagagaaaactggccagaggccatctgaagccaaagagataaaactttatgcccagattccccctatagagaagatggatgcatccttgtccatgcttgctaattgcgagaagctttcactgtctacaaactgcattgaaaaaattgccaacctgaatggcttaaaaaacttgaggatattatctttaggaagaaacaacataaagaacttaaatggactgagatggggtttcaccgtagtagccaggatggtctcgatctcctgacctcatgatccgcctgcctcggcctcccaaagtgctgggattacaggcgtgagccaccacacctgggcaaaatttgatatttgtgatgttctaaataaattggaggcagtaggggacacattagaagaactgtggatctcctacaattttattgagaagttgaaagggatccacataatgaagaaattgaagattctctacatgtctaataacctggtaaaagactgggctgagtttgtgaagctggcagaactgccatgcctcgaagacctggtgtttgtaggcaatcccttggaagagaaacattctgctgagaataactggattgaagaagcaaccaagagagtgcccaaactgaaaaagctggatggtactccagtaattaaaggggatgaggaagaagacaactaatgccacgctttccactgtgtgttaacttatttaaatgtcataagaacaatagataaattttatataattgtctattttaaagattctgtatgggacaaaagtttcttaagataaaacagatcactcattctcatctttttttttcctttaacttattcagtgtttctccccaaaactggtaatgccaaccttatatatcctatttctctttttagaaaccacaaattttcgatttttgtcttcagtctcagttacgtactgtgtagccccatctatcgggaggctgaggcaggagaattgcttgaacccgggaggcagaggcttcagtgagccgaaatagtgtgactgtactccagcctgggtgacagagtaagtctccgtctcaaaaagaaaaaaaaaatgtggttcttttgtggaaagaggaatttgaacttgaataaacacttcttttgacaccttttaccagtggtctgaagcagaataaggaagaataagaaatgaatcttgactgttgacttattctgagaattggtgatgtgtaaagagagttggaatcttctacctgggtttttctcagggctaaatggaaaagcacagggcccagaaaggttggagttaatcattcacttaaaagcattaggaggaagtgtcaaagcatcagtcatgaatagattatgtctctctgactacagtcagaccatcaattcactaagaccttatactctgtaagtgttggtaaaggaagaaaactgctaaattgcatgttaccctttactagaaattcattcctttggcacagattttatttatttggggctgtttaatgtgtctgtaaatcatgaaatataaaagcaagattcagtgtagcagagttggtgcttcttctgacaagctaacttgaccatatttctttatctgtgctctaacatgtgtcatattgttttctttttgtaaaccataaaatgggtgaacttccaaaaatcaagggtcatgttttaaaatcatggaacttttagaaataccatatctgtatctctattcctgcattttataaatctgtaaaggaagaaaactgaaaggaagaactagactgagtcttacctttctctgacctaagataaactgataaaactttttacttgatatttggagaagtcattaactggattctagttaatttcccatattgggcagtttagaggagacccagccaaccaaattatgatctagcaaatttaacataggggaagagggatagtaaactatttttcagtagatttgcactttaaacttaggaactggatgttggtggaaaggacttccatagggcagatgggtaaatatctagcctgcacttggatgttagagaatcaaacctcacccttgctcgttctaaacccacatgagtagttaactgtcttttgacataatcagagtcaggatttccctttttccctacttgagtcgtcttccatgtctgttacatccaagatcatccctctgggggatgtgtcaagtagttctcctactcagaatagaagctttgcgaattatcattcccacctctagattttaaatgaatgtagagttgtctaacattatatgggtgggaggctctttgcctctgtgatcagtagggtacctgcctctgaggtgctactgcctggagggatcactcccatcaaaagactggtgagttggaagctaagagcacatgcgcatagccagctcctctcccaggctggcagtcatgattacgagcatcattccagaatctttggcttctagaaccaactccattctgaagaacattttaacatctatgaataccttggtaataatcttttatacacaggagttttgtagcatgactttatgactaaacttattgtgaattaagttatttagaaatgttgagtttctgaatgttattttgtgatttgtttcaaaatagtaataaattgtgttattttgtaaaaaaaaaa

SEQ ID NO: 437264 - DNA, 2219 bp, Homo sapiens
aggcatgagccaccgtgcctggccaaatttcttctattcttgtaagtgatggtaaaactctggaatcagtccagtattttagtttttcacagcaaatttgattttagtctaccaaggagtttaacttttctatgttccctaactctaagattagggctgtattacctagacaggccttaaaaggtttttgtgttgttctctgttaataagaatttgttcctttaaaccagaggatcaaccttggaactattaacattttgggattgataattcattgttgttgggggctgtcctgtgtgcttaggatgttcagctgcagccctggcctctacccactagattccagtagaccccctcctcagccatgacaacaaagatatctccagacattgccatctgtcccttgggtaggagggtgggaacaaattctcccttagttgtactttttataccaacatcacttgtgtccagggtccatttattttcagtctgtagccatgtgccacttgaattgttatatgagagaaggtgatgtattcagtaatcatggatggaaagaaatggtcactggtattttttgtaatgtccagcctgggtgacagagtaagtctccgtctcaaaaagaaaaaaaaaatgtggttcttttgtggaaagaggaatttgaacttgaataaacacttcttttgacaccttttaccagtggtctgaagcagaataaggaagaataagaaatgaatcttgactgttgacttattctgagaattggtgatgtgtaaagagagttggaatcttctacctgggtttttctcagggctaaatggaaaagcacagggcccagaaaggttggagttaatcattcacttaaaagcattaggaggaagtgtcaaagcatcagtcatgaatagattatgtctctctgactacagtcagaccatcaattcactaagaccttatactctgtaagtgttggtaaaggaagaaaactgctaaattgcatgttaccctttactagaaattcattcctttggcacagattttatttatttggggctgtttaatgtgtctgtaaatcatgaaatataaaagcaagattcagtgtagcagagttggtgcttcttctgacaagctaacttgaccatatttctttatctgtgctctaacatgtgtcatattgttttctttttgtaaaccataaaatgggtgaacttccaaaaatcaagggtcatgttttaaaatcatggaacttttagaaataccatatctgtatctctattcctgcattttataaatctgtaaaggaagaaaactgaaaggaagaactagactgagtcttacctttctctgacctaagataaactgataaaactttttacttgatatttggagaagtcattaactggattctagttaatttcccatattgggcagtttagaggagacccagccaaccaaattatgatctagcaaatttaacataggggaagagggatagtaaactatttttcagtagatttgcactttaaacttaggaactggatgttggtggaaaggacttccatagggcagatgggtaaatatctagcctgcacttggatgttagagaatcaaacctcacccttgctcgttctaaacccacatgagtagttaactgtcttttgacataatcagagtcaggatttccctttttccctacttgagtcgtcttccatgtctgttacatccaagatcatccctctgggggatgtgtcaagtagttctcctactcagaatagaagctttgcgaattatcattcccacctctagattttaaatgaatgtagagttgtctaacattatatgggtgggaggctctttgcctctgtgatcagtagggtacctgcctctgaggtgctactgcctggagggatcactcccatcaaaagactggtgagttggaagctaagagcacatgcgcatagccagctcctctcccaggctggcagtcatgattacgagcatcattccagaatctttggcttctagaaccaactccattctgaagaacattttaacatctatgaataccttggtaataatcttttatacacaggagttttgtagcatgactttatgactaaacttattgtgaattaagttatttagaaatgttgagtttctgaatgttattttgtgatttgtttcaaaatagtaataaattgtgttattttgtaaaaaaaaaa

SEQ ID NO: 437265 - DNA, 2437 bp, Homo sapiens
aagcagtggtatcaacgcagagggcccattacggccggggctagcaaccagagcagtgacagtagcaaccgccggaatggcgaaagcaacaacaatcaaagaagccttagcgagatgggaagagaaaactggccagaggccatctgaagccaaagagataaaactttatgcccagattccccctatagagaagatggatgcatccttgtccatgcttgctaattgcgagaagctttcactgtctacaaactgcattgaaaaaattgccaacctgaatggcttaagaggcagtaggggacacattagaagaactgtggatctcctacaattttattgagaagttgaaagggatccacataatgaagaaattgaagattctctacatgtctaataacctggtaaaagactggggtactccagtaattaaaggggatgaggaagaagacaactaatgccacgctttccactgtgtgttaacttatttaaatgtcataagaacaatagataaattttatataattgtctattttaaagattctgtatgggacaaaagtttcttaagataaaacagatcactcattctcatctttttttttcctttaacttattcagtgtttctccccaaaactggtaatgccaaccttatatatcctatttctctttttagaaaccacaaattttcgatttttgtcttcagtctcagttacgtactgtgtagccccatctatcgggaggctgaggcaggagaattgcttgaacccgggaggcagaggcttcagtgagccgaaatagtgtgactgtactccagcctgggtgacagagtaagtctccgtctcaaaaagaaaaaaaaaatgtggttcttttgtggaaagaggaatttgaacttgaataaacacttcttttgacaccttttaccagtggtctgaagcagaataaggaagaataagaaatgaatcttgactgttgacttattctgagaattggtgatgtgtaaagagagttggaatcttctacctgggtttttctcagggctaaatggaaaagcacagggcccagaaaggttggagttaatcattcacttaaaagcattaggaggaagtgtcaaagcatcagtcatgaatagattatgtctctctgactacagtcagaccatcaattcactaagaccttatactctgtaagtgttggtaaaggaagaaaactgctaaattgcatgttaccctttactagaaattcattcctttggcacagattttatttatttggggctgtttaatgtgtctgtaaatcatgaaatataaaagcaagattcagtgtagcagagttggtgcttcttctgacaagctaacttgaccatatttctttatctgtgctctaacatgtgtcatattgttttctttttgtaaaccataaaatgggtgaacttccaaaaatcaagggtcatgttttaaaatcatggaacttttagaaataccatatctgtatctctattcctgcattttataaatctgtaaaggaagaaaactgaaaggaagaactagactgagtcttacctttctctgacctaagataaactgataaaactttttacttgatatttggagaagtcattaactggattctagttaatttcccatattgggcagtttagaggagacccagccaaccaaattatgatctagcaaatttaacataggggaagagggatagtaaactatttttcagtagatttgcactttaaacttaggaactggatgttggtggaaaggacttccatagggcagatgggtaaatatctagcctgcacttggatgttagagaatcaaacctcacccttgctcgttctaaacccacatgagtagttaactgtcttttgacataatcagagtcaggatttccctttttccctacttgagtcgtcttccatgtctgttacatccaagatcatccctctgggggatgtgtcaagtagttctcctactcagaatagaagctttgcgaattatcattcccacctctagattttaaatgaatgtagagttgtctaacattatatgggtgggaggctctttgcctctgtgatcagtagggtacctgcctctgaggtgctactgcctggagggatcactcccatcaaaagactggtgagttggaagctaagagcacatgcgcatagccagctcctctcccaggctggcagtcatgattacgagcatcattccagaatctttggcttctagaaccaactccattctgaagaacattttaacatctatgaataccttggtaataatcttttatacacaggagttttgtagcatgactttatgactaaacttattgtgaattaagttatttagaaatgttgagtttctgaatgttattttgtgatttgtttcaaaatagtaataaattgtgttattttgtaaaaaaaaaa

SEQ ID NO: 437266 - DNA, 1821 bp, Homo sapiens
cttgaggtcaggagttcgaggccagcctggccaacgtggtgaaaccccatgtctaccaaaaatataaaaagatagccgggcgtggtggcgcatgcctgtaatcccagctactcgggaggctgaggcaggagaattgcttgaacccgggaggcagaggcttcagtgagccgaaatagtgtgactgtactccagcctgggtgacagagtaagtctccgtctcaaaaagaaaaaaaaaatgtggttcttttgtggaaagaggaatttgaacttgaataaacacttcttttgacaccttttaccagtggtctgaagcagaataaggaagaataagaaatgaatcttgactgttgacttattctgagaattggtgatgtgtaaagagagttggaatcttctacctgggtttttctcagggctaaatggaaaagcacagggcccagaaaggttggagttaatcattcacttaaaagcattaggaggaagtgtcaaagcatcagtcatgaatagattatgtctctctgactacagtcagaccatcaattcactaagaccttatactctgtaagtgttggtaaaggaagaaaactgctaaattgcatgttaccctttactagaaattcattcctttggcacagattttatttatttggggctgtttaatgtgtctgtaaatcatgaaatataaaagcaagattcagtgtagcagagttggtgcttcttctgacaagctaacttgaccatatttctttatctgtgctctaacatgtgtcatattgttttctttttgtaaaccataaaatgggtgaacttccaaaaatcaagggtcatgttttaaaatcatggaacttttagaaataccatatctgtatctctattcctgcattttataaatctgtaaaggaagaaaactgaaaggaagaactagactgagtcttacctttctctgacctaagataaactgataaaactttttacttgatatttggagaagtcattaactggattctagttaatttcccatattgggcagtttagaggagacccagccaaccaaattatgatctagcaaatttaacataggggaagagggatagtaaactatttttcagtagatttgcactttaaacttaggaactggatgttggtggaaaggacttccatagggcagatgggtaaatatctagcctgcacttggatgttagagaatcaaacctcacccttgctcgttctaaacccacatgagtagttaactgtcttttgacataatcagagtcaggatttccctttttccctacttgagtcgtcttccatgtctgttacatccaagatcatccctctgggggatgtgtcaagtagttctcctactcagaatagaagctttgcgaattatcattcccacctctagattttaaatgaatgtagagttgtctaacattatatgggtgggaggctctttgcctctgtgatcagtagggtacctgcctctgaggtgctactgcctggagggatcactcccatcaaaagactggtgagttggaagctaagagcacatgcgcatagccagctcctctcccaggctggcagtcatgattacgagcatcattccagaatctttggcttctagaaccaactccattctgaagaacattttaacatctatgaataccttggtaataatcttttatacacaggagttttgtagcatgactttatgactaaacttattgtgaattaagttatttagaaatgttgagtttctgaatgttattttgtgatttgtttcaaaatagtaataaattgtgttattttgtaaaaaaaaaa

SEQ ID NO: 437267 - DNA, 617 bp, Homo sapiens
aggcatgagccaccgtgcctggccaaatttcttctattcttgtaagtgatggtaaaactctggaatcagtccagtattttagtttttcacagcaaatttgattttagtctaccaaggagtttaacttttctatgttccctaactctaagattagggctgtattacctagacaggccttaaaaggtttttgtgttgttctctgttaataagaatttgttcctttaaaccagaggatcaaccttggaactattaacattttgggattgataattcattgttgttgggggctgtcctgtgtgcttaggatgttcagctgcagccctggcctctacccactagattccagtagaccccctcctcagccatgacaacaaagatatctccagacattgccatctgtcccttgggtaggagggtgggaacaaattctcccttagttgtactttttataccaacatcacttgtgtccagggtccatttattttcagtctgtagccatgtgccacttgaattgttatatgagagaaggtgatgtattcagtaatcatggatggaaagaaatggtcactggtattttttgtaatgctcatttttttttttttttgagacagagtctc

SEQ ID NO: 437268 - DNA, 2634 bp, Homo sapiens
aagcagtggtatcaacgcagagggcccattacggccggggctagcaaccagagcagtgacagtagcaaccgccggaatggcgaaagcaacaacaatcaaagaagccttagcgagatgggaagagaaaactggccagaggccatctgaagccaaagagataaaactttatgcccagattccccctatagagaagatggatgcatccttgtccatgcttgctaattgcgagaagctttcactgtctacaaactgcattgaaaaaattgccaacctgaatggcttaaaaaacttgaggatattatctttaggaagaaacaacataaagaacttaaatggactggaggcagtaggggacacattagaagaactgtggatctcctacaattttattgagaagttgaaagggatccacataatgaagaaattgaagattctctacatgtctaataacctggtaaaagactgggctgagtttgtgaagctggcagaactgccatgcctcgaagacctggtgtttgtaggcaatcccttggaagagaaacattctgctgagaataactggattgaagaagcaaccaagagagtgcccaaactgaaaaagctggatggtactccagtaattaaaggggatgaggaagaagacaactaatgccacgctttccactgtgtgttaacttatttaaatgtcataagaacaatagataaattttatataattgtctattttaaagattctgtatgggacaaaagtttcttaagataaaacagatcactcattctcatctttttttttcctttaacttattcagtgtttctccccaaaactggtaatgccaaccttatatatcctatttctctttttagaaaccacaaattttcgatttttgtcttcagtctcagttacgtactgtgtagccccatctatcgggaggctgaggcaggagaattgcttgaacccgggaggcagaggcttcagtgagccgaaatagtgtgactgtactccagcctgggtgacagagtaagtctccgtctcaaaaagaaaaaaaaaatgtggttcttttgtggaaagaggaatttgaacttgaataaacacttcttttgacaccttttaccagtggtctgaagcagaataaggaagaataagaaatgaatcttgactgttgacttattctgagaattggtgatgtgtaaagagagttggaatcttctacctgggtttttctcagggctaaatggaaaagcacagggcccagaaaggttggagttaatcattcacttaaaagcattaggaggaagtgtcaaagcatcagtcatgaatagattatgtctctctgactacagtcagaccatcaattcactaagaccttatactctgtaagtgttggtaaaggaagaaaactgctaaattgcatgttaccctttactagaaattcattcctttggcacagattttatttatttggggctgtttaatgtgtctgtaaatcatgaaatataaaagcaagattcagtgtagcagagttggtgcttcttctgacaagctaacttgaccatatttctttatctgtgctctaacatgtgtcatattgttttctttttgtaaaccataaaatgggtgaacttccaaaaatcaagggtcatgttttaaaatcatggaacttttagaaataccatatctgtatctctattcctgcattttataaatctgtaaaggaagaaaactgaaaggaagaactagactgagtcttacctttctctgacctaagataaactgataaaactttttacttgatatttggagaagtcattaactggattctagttaatttcccatattgggcagtttagaggagacccagccaaccaaattatgatctagcaaatttaacataggggaagagggatagtaaactatttttcagtagatttgcactttaaacttaggaactggatgttggtggaaaggacttccatagggcagatgggtaaatatctagcctgcacttggatgttagagaatcaaacctcacccttgctcgttctaaacccacatgagtagttaactgtcttttgacataatcagagtcaggatttccctttttccctacttgagtcgtcttccatgtctgttacatccaagatcatccctctgggggatgtgtcaagtagttctcctactcagaatagaagctttgcgaattatcattcccacctctagattttaaatgaatgtagagttgtctaacattatatgggtgggaggctctttgcctctgtgatcagtagggtacctgcctctgaggtgctactgcctggagggatcactcccatcaaaagactggtgagttggaagctaagagcacatgcgcatagccagctcctctcccaggctggcagtcatgattacgagcatcattccagaatctttggcttctagaaccaactccattctgaagaacattttaacatctatgaataccttggtaataatcttttatacacaggagttttgtagcatgactttatgactaaacttattgtgaattaagttatttagaaatgttgagtttctgaatgttattttgtgatttgtttcaaaatagtaataaattgtgttattttgtaaaaaaaaaa

SEQ ID NO: 437269 - DNA, 540 bp, Homo sapiens
ctgtggggaggggtttttaaagttttaaaaatctagcttttgggtgagtgcagtggctcatgccagtaatcccacctcagcctcccaaatagctgggactacaggtgcatggcactatgtctggctaatttttaaatttttctgtagagatgaggtccctccatgttgcctaggctggtcttgaacttttgggctcaagagtcctcctgccttggctccccgaggtgctgggattattatagtcatgagctactgctcctgacctagtgataactttttgaattccaattccttgatcctttagcatcctaggcaaagacaaccatttctgctgggtaaagcacagtgaaaagccctgcttctctgtatacaaatgaaacagattgtacaattaatatgtattgggtgctgcatggtccatcctaacagtagtgctaattgccatatcatttatttttacatttggaagtattttactttggcctcaatgtaattttgtttttttaatgctgtagagtgtatgggatataggtaaggagt

SEQ ID NO: 437270 - DNA, 345 bp, Homo sapiens
ctcccaaagggctgggatgatgggtgagccatggtgcccagccgagaatgtccttcaaaaaaatacatttcaattcagacatttatggcaccccgtctcaaaaaaaagaagtgtgccgttgaaaatgaggtttgttcagtactgatcgtggggaaccctttctcctgagataactgtaagagccttgtgtcctgagaggccctggagctattcttggggaattgaggtgggcagagattggcagcccctgggacctgcttggctccaggcgatctgacagcagggaggattgcgaagtacagatctgtagacggggcgtggttttcaaaaccatccgtggaggct

SEQ ID NO: 437271 - DNA, 1895 bp, Homo sapiens
ggaaacagcagccgtggccaagctgaccccagagcccttcccttcctggccctccctctgaatcatcgcgctccacttgtgacgtcgcggacgcccggctcgggcaggcgtggggggcccgcgcgtcccgggagccccgaggcggcagcgcgcgtttccacgccgcggtcccgcgggaaagccgggggcggcggcctggctgaggccaagctcggatccggtgccgagccaagcggggccgtgcgtcgccggggcttcgccttcgctcgcgtgacctccgccgtcctccccaaccctcgtcctctggccgcgcctgcggccgcacgcccagcgcccctcgcctaacctcgcgcccgggccgcgcctcctcctcctcctgctccccgccgcttccgtttctcgagggaaaggctgctgcctcctgctctgtcctcatccccggcttagctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaagaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatagattcaacttatcagtatataaaaggttctgctgacattaaatccaaccagggaatcttcccctgtggacttcagtgtgtcaccattttaattggtgtctatgacatacagacaggggttcccctgatgggagtcatcaatcaaccttttgtgtcacgagatccaaacaccctcaggtggaaaggacagtgctattggggcctttcttacatggggaccaacatgcattcactacagctcaccatctctagaagaaacggcagtgaaacacacactggaaacaccggctctgaggcagcattctcccccagtttttcagccgtaattagtacaagtgaaaaggagactatcaaagctgcattgtcacgtgtgtgtggagatcgcatatttggggcagctggggctggttataagagcctatgtgttgtccaaggcctcgttgacatttacatcttttcagaagataccacattcaaatgggactcttgtgctgctcatgccatactgcgggccatgggtgggggaatagtagacttgaaagaatgcttagaaagaaatccagaaacagggcttgatttgccacagttggtgtaccacgtggaaaatgagggtgctgctggggtggatcggtgggccaacaagggaggactcattgcatacagatccaggaagcggctggagacattcctgagcctcctggtccaaaacctggcacctgcagagacgcatacctagaggaactctaaccccggtgtacctgtataaactgaactgtgaaactgtttcggttatctctgtcttttgaggatggctttgtcctgttgctggttaacattcaccttcctcttttgaggagtatttttccattatgtattcataataatgttaatttcaataaatgacattcatgcagcaatta

SEQ ID NO: 437272 - DNA, 2012 bp, Homo sapiens
ggaaacagcagccgtggccaagctgaccccagagcccttcccttcctggccctccctctgaatcatcgcgctccacttgtgacgtcgcggacgcccggctcgggcaggcgtggggggcccgcgcgtcccgggagccccgaggcggcagcgcgcgtttccacgccgcggtcccgcgggaaagccgggggcggcggcctggctgaggccaagctcggatccggtgccgagccaagcggggccgtgcgtcgccggggcttcgccttcgctcgcgtgacctccgccgtcctccccaaccctcgtcctctggccgcgcctgcggccgcacgcccagcgcccctcgcctaacctcgcgcccgggccgcgcctcctcctcctcctgctccccgccgcttccgtttctcgagggaaaggctgctgcctcctgctctgtcctcatccccggcttaggtaacacgttttcctccttacgacacccaccacagggtccccgcgccgctgcccctcctccttggatctggggcccgggctggtgagcggcgcgcgccgtcgcctcttcgcgggtagctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaagaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatagattcaacttatcagtatataaaaggttctgctgacattaaatccaaccagggaatcttcccctgtggacttcagtgtgtcaccattttaattggtgtctatgacatacagacaggggttcccctgatgggagtcatcaatcaaccttttgtgtcacgagatccaaacaccctcaggtggaaaggacagtgctattggggcctttcttacatggggaccaacatgcattcactacagctcaccatctctagaagaaacggcagtgaaacacacactggaaacaccggctctgaggcagcattctcccccagtttttcagccgtaattagtacaagtgaaaaggagactatcaaagctgcattgtcacgtgtgtgtggagatcgcatatttggggcagctggggctggttataagagcctatgtgttgtccaaggcctcgttgacatttacatcttttcagaagataccacattcaaatgggactcttgtgctgctcatgccatactgcgggccatgggtgggggaatagtagacttgaaagaatgcttagaaagaaatccagaaacagggcttgatttgccacagttggtgtaccacgtggaaaatgagggtgctgctggggtggatcggtgggccaacaagggaggactcattgcatacagatccaggaagcggctggagacattcctgagcctcctggtccaaaacctggcacctgcagagacgcatacctagaggaactctaaccccggtgtacctgtataaactgaactgtgaaactgtttcggttatctctgtcttttgaggatggctttgtcctgttgctggttaacattcaccttcctcttttgaggagtatttttccattatgtattcataataatgttaatttcaataaatgacattcatgcagcaatta

SEQ ID NO: 437273 - DNA, 2152 bp, Homo sapiens
ggaaacagcagccgtggccaagctgaccccagagcccttcccttcctggccctccctctgaatcatcgcgctccacttgtgacgtcgcggacgcccggctcgggcaggcgtggggggcccgcgcgtcccgggagccccgaggcggcagcgcgcgtttccacgccgcggtcccgcgggaaagccgggggcggcggcctggctgaggccaagctcggatccggtgccgagccaagcggggccgtgcgtcgccggggcttcgccttcgctcgcgtgacctccgccgtcctccccaaccctcgtcctctggccgcgcctgcggccgcacgcccagcgcccctcgcctaacctcgcgcccgggccgcgcctcctcctcctcctgctccccgccgcttccgtttctcgagggaaaggctgctgcctcctgctctgtcctcatccccggcttaggtaacacgttttcctccttacgacacccaccacagggtccccgcgccgctgcccctcctccttggatctggggcccgggctggtgagcggcgcgcgccgtcgcctcttcgcgggtaggtgagtcgatggcgccgggagggttcctcgcctctgcgcgccggcctgcgaggtccctgccccggcagcgaggccgcccccggccgggcccggccaggcatgcccggcatcgccgctgcagccagcgcggaggggagctcctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaagaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatagattcaacttatcagtatataaaaggttctgctgacattaaatccaaccagggaatcttcccctgtggacttcagtgtgtcaccattttaattggtgtctatgacatacagacaggggttcccctgatgggagtcatcaatcaaccttttgtgtcacgagatccaaacaccctcaggtggaaaggacagtgctattggggcctttcttacatggggaccaacatgcattcactacagctcaccatctctagaagaaacggcagtgaaacacacactggaaacaccggctctgaggcagcattctcccccagtttttcagccgtaattagtacaagtgaaaaggagactatcaaagctgcattgtcacgtgtgtgtggagatcgcatatttggggcagctggggctggttataagagcctatgtgttgtccaaggcctcgttgacatttacatcttttcagaagataccacattcaaatgggactcttgtgctgctcatgccatactgcgggccatgggtgggggaatagtagacttgaaagaatgcttagaaagaaatccagaaacagggcttgatttgccacagttggtgtaccacgtggaaaatgagggtgctgctggggtggatcggtgggccaacaagggaggactcattgcatacagatccaggaagcggctggagacattcctgagcctcctggtccaaaacctggcacctgcagagacgcatacctagaggaactctaaccccggtgtacctgtataaactgaactgtgaaactgtttcggttatctctgtcttttgaggatggctttgtcctgttgctggttaacattcaccttcctcttttgaggagtatttttccattatgtattcataataatgttaatttcaataaatgacattcatgcagcaatta

SEQ ID NO: 437274 - DNA, 2156 bp, Homo sapiens
ggaaacagcagccgtggccaagctgaccccagagcccttcccttcctggccctccctctgaatcatcgcgctccacttgtgacgtcgcggacgcccggctcgggcaggcgtggggggcccgcgcgtcccgggagccccgaggcggcagcgcgcgtttccacgccgcggtcccgcgggaaagccgggggcggcggcctggctgaggccaagctcggatccggtgccgagccaagcggggccgtgcgtcgccggggcttcgccttcgctcgcgtgacctccgccgtcctccccaaccctcgtcctctggccgcgcctgcggccgcacgcccagcgcccctcgcctaacctcgcgcccgggccgcgcctcctcctcctcctgctccccgccgcttccgtttctcgagggaaaggctgctgcctcctgctctgtcctcatccccggcttaggtaacacgttttcctccttacgacacccaccacagggtccccgcgccgctgcccctcctccttggatctggggcccgggctggtgagcggcgcgcgccgtcgcctcttcgcgggtagtccttcagagcttacatcatgtggccgagtttatatacctgattggcaaaacagagcctaagaaccagctctcctgtatcccaagcaaggctctttctaccgcacaccctgcaggcccatccaggcccatccagacaataaacactgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaagaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatagattcaacttatcagtatataaaaggttctgctgacattaaatccaaccagggaatcttcccctgtggacttcagtgtgtcaccattttaattggtgtctatgacatacagacaggggttcccctgatgggagtcatcaatcaaccttttgtgtcacgagatccaaacaccctcaggtggaaaggacagtgctattggggcctttcttacatggggaccaacatgcattcactacagctcaccatctctagaagaaacggcagtgaaacacacactggaaacaccggctctgaggcagcattctcccccagtttttcagccgtaattagtacaagtgaaaaggagactatcaaagctgcattgtcacgtgtgtgtggagatcgcatatttggggcagctggggctggttataagagcctatgtgttgtccaaggcctcgttgacatttacatcttttcagaagataccacattcaaatgggactcttgtgctgctcatgccatactgcgggccatgggtgggggaatagtagacttgaaagaatgcttagaaagaaatccagaaacagggcttgatttgccacagttggtgtaccacgtggaaaatgagggtgctgctggggtggatcggtgggccaacaagggaggactcattgcatacagatccaggaagcggctggagacattcctgagcctcctggtccaaaacctggcacctgcagagacgcatacctagaggaactctaaccccggtgtacctgtataaactgaactgtgaaactgtttcggttatctctgtcttttgaggatggctttgtcctgttgctggttaacattcaccttcctcttttgaggagtatttttccattatgtattcataataatgttaatttcaataaatgacattcatgcagcaatta

SEQ ID NO: 437275 - DNA, 1686 bp, Homo sapiens
tctgacttgatgaagccccaccaggtgattctggcagtcagccaggcataggaactgctgggatggatatattgccctcaatctaagtgcacagcttttgattcactctctcactggctcactctctctctgtctctcttgcttgctctctcgctctctctgtctcaatctttgtctcattctctcgctgtctctctcgcttctgtctctctctgtgtctcttgctctgtctcgctctcttgctctgtctcactgtctctcgctcactgtctgtctcactcttttgctctctctcgctctctcgctctgtctcgctctctctcgctctcactctgtctcactctgtctcactctctctgtcttgctctctctgtctctcgctcttttgctgtgtctctcgctctctctgtgtgtctctctctcactctcttgctctgtctctctcgcttctctctctgtctctctctctcgctctctctgtctctctcactctttagctctctctctctgttctttctccactgaaactcttgaaatgtaatggcttatcgtgtggctttaccctaggggaaaagattaccttgaggttgtgttcaacagaggaagaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatagattcaacttatcagtatataaaaggttctgctgacattaaatccaaccagggaatcttcccctgtggacttcagtgtgtcaccattttaattggtgtctatgacatacagacaggggttcccctgatgggagtcatcaatcaaccttttgtgtcacgagatccaaacaccctcaggtggaaaggacagtgctattggggcctttcttacatggggaccaacatgcattcactacagctcaccatctctagaagaaacggcagtgaaacacacactggaaacaccggctctgaggcagcattctcccccagtttttcagccgtaattagtacaagtgaaaaggagactatcaaagctgcattgtcacgtgtgtgtggagatcgcatatttggggcagctggggctggttataagagcctatgtgttgtccaaggcctcgttgacatttacatcttttcagaagataccacattcaaatgggactcttgtgctgctcatgccatactgcgggccatgggtgggggaatagtagacttgaaagaatgcttagaaagaaatccagaaacagggcttgatttgccacagttggtgtaccacgtggaaaatgagggtgctgctggggtggatcggtgggccaacaagggaggactcattgcatacagatccaggaagcggctggagacattcctgagcctcctggtccaaaacctggcacctgcagagacgcatacctagaggaactctaaccccggtgtacctgtataaactgaactgtgaaactgtttcggttatctctgtcttttgaggatggctttgtcctgttgctggttaacattcaccttcctcttttgaggagtatttttccattatgtattcataataatgttaatttcaataaatgacattcatgcagcaatta

SEQ ID NO: 437276 - DNA, 1381 bp, Homo sapiens
  misc_feature (1260)..(1260): n is a, c, g, or t
  misc_feature (1291)..(1292): n is a, c, g, or t
  misc_feature (1306)..(1306): n is a, c, g, or t
  misc_feature (1312)..(1312): n is a, c, g, or t
  misc_feature (1316)..(1316): n is a, c, g, or t
ggaaacagcagccgtggccaagctgaccccagagcccttcccttcctggccctccctctgaatcatcgcgctccacttgtgacgtcgcggacgcccggctcgggcaggcgtggggggcccgcgcgtcccgggagccccgaggcggcagcgcgcgtttccacgccgcggtcccgcgggaaagccgggggcggcggcctggctgaggccaagctcggatccggtgccgagccaagcggggccgtgcgtcgccggggcttcgccttcgctcgcgtgacctccgccgtcctccccaaccctcgtcctctggccgcgcctgcggccgcacgcccagcgcccctcgcctaacctcgcgcccgggccgcgcctcctcctcctcctgctccccgccgcttccgtttctcgagggaaaggctgctgcctcctgctctgtcctcatccccggcttagctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaagaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatagattcaacttatcagtatataaaaggttctgctgacattaaatccaaccagggaatcttcccctgtggacttcagtgtgtcaccattttaattggtgtctatgacatacagacaggggttcccctgatgggagtcatcaatcaaccttttgtgtcacgagatccaaacaccctcaggtggaaaggacagtgctattggggcctttcttacatggggaccaacatgcattcactacagctcaccatctctagaagaaacggcagtgaaacacacactggggaccnacatgcattcactacagctcaccatctctannagaacggcagtganacacanctgnaacaccggctctgggggagatgctgcctcagagatccatacaccccgaccggtaccagcctgctt

SEQ ID NO: 437277 - DNA, 1724 bp, Homo sapiens
gaattcatctgtccactgctacccctggctgaggccaagctcggatccggtgccgagccaagcggggccgtgcgtcgccggggcttcgccttcgctcgcgtgacctccgccgtcctccccaaccctcgtcctctggccgcgcctgcggccgcacgcccagcgcccctcgcctaacctcgcgcccgggccgcgcctcctcctcctcctgctccccgccgcttccgtttctcgagggaaaggctgctgcctcctgctctgtcctcatccccggcttagctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaagaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatagattcaacttatcagtatataaaaggttctgctgacattaaatccaaccagggaatcttcccctgtggacttcagtgtgtcaccattttaattggtgtctatgacatacagacaggggttcccctgatgggagtcatcaatcaaccttttgtgtcacgagatccaaacaccctcaggtggaaaggacagtgctattggggcctttcttacatggggaccaacatgcattcactacagctcaccatctctagaagaaacggcagtgaaacacacactggaaacaccggctctgaggcagcattctcccccagtttttcagccgtaattagtacaagtgaaaaggagactatcaaagctgcattgtcacgtgtgtgtggagatcgcatatttggggcagctggggctggttataagagcctatgtgttgtccaaggcctcgttgacatttacatcttttcagaagataccacattcaaatgggactcttgtgctgctcatgccatactgcgggccatgggtgggggaatagtagacttgaaagaatgcttagaaagaaatccagaaacagggcttgatttgccacagttggtgtaccacgtggaaaatgagggtgctgctggggtggatcggtgggccaacaagggaggactcattgcatacagatccaggaagcggctggagacattcctgagcctcctggtccaaaacctggcacctgcagagacgcatacctagaggaactctaaccccggtgtacctgtataaactgaactgtgaaactgtttcggttatctctgtcttttgaggatggctttgtcctgttgctggttaacattcaccttcctcttttgaggagtatttttccattatgtattcataataatgttaatttcaataaatgacattcatgcagcaatta

SEQ ID NO: 437278 - DNA, 2039 bp, Homo sapiens
ggaaacagcagccgtggccaagctgaccccagagcccttcccttcctggccctccctctgaatcatcgcgctccacttgtgacgtcgcggacgcccggctcgggcaggcgtggggggcccgcgcgtcccgggagccccgaggcggcagcgcgcgtttccacgccgcggtcccgcgggaaagccgggggcggcggcctggctgaggccaagctcggatccggtgccgagccaagcggggccgtgcgtcgccggggcttcgccttcgctcgcgtgacctccgccgtcctccccaaccctcgtcctctggccgcgcctgcggccgcacgcccagcgcccctcgcctaacctcgcgcccgggccgcgcctcctcctcctcctgctccccgccgcttccgtttctcgagggaaaggctgctgcctcctgctctgtcctcatccccggcttagtccttcagagcttacatcatgtggccgagtttatatacctgattggcaaaacagagcctaagaaccagctctcctgtatcccaagcaaggctctttctaccgcacaccctgcaggcccatccaggcccatccagacaataaacactgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaagaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatagattcaacttatcagtatataaaaggttctgctgacattaaatccaaccagggaatcttcccctgtggacttcagtgtgtcaccattttaattggtgtctatgacatacagacaggggttcccctgatgggagtcatcaatcaaccttttgtgtcacgagatccaaacaccctcaggtggaaaggacagtgctattggggcctttcttacatggggaccaacatgcattcactacagctcaccatctctagaagaaacggcagtgaaacacacactggaaacaccggctctgaggcagcattctcccccagtttttcagccgtaattagtacaagtgaaaaggagactatcaaagctgcattgtcacgtgtgtgtggagatcgcatatttggggcagctggggctggttataagagcctatgtgttgtccaaggcctcgttgacatttacatcttttcagaagataccacattcaaatgggactcttgtgctgctcatgccatactgcgggccatgggtgggggaatagtagacttgaaagaatgcttagaaagaaatccagaaacagggcttgatttgccacagttggtgtaccacgtggaaaatgagggtgctgctggggtggatcggtgggccaacaagggaggactcattgcatacagatccaggaagcggctggagacattcctgagcctcctggtccaaaacctggcacctgcagagacgcatacctagaggaactctaaccccggtgtacctgtataaactgaactgtgaaactgtttcggttatctctgtcttttgaggatggctttgtcctgttgctggttaacattcaccttcctcttttgaggagtatttttccattatgtattcataataatgttaatttcaataaatgacattcatgcagcaatta

SEQ ID NO: 437279 - DNA, 1948 bp, Homo sapiens
ggaaacagcagccgtggccaagctgaccccagagcccttcccttcctggccctccctctgaatcatcgcgctccacttgtgacgtcgcggacgcccggctcgggcaggcgtggggggcccgcgcgtcccgggagccccgaggcggcagcgcgcgtttccacgccgcggtcccgcgggaaagccgggggcggcggcctggctgaggccaagctcggatccggtgccgagccaagcggggccgtgcgtcgccggggcttcgccttcgctcgcgtgacctccgccgtcctccccaaccctcgtcctctggccgcgcctgcggccgcacgcccagcgcccctcgcctaacctcgcgcccgggccgcgcctcctcctcctcctgctccccgccgcttccgtttctcgagggaaaggctgctgcctcctgctctgtcctcatccccggcttagggtgaaagaaagcactacttcaatattgctgctaagcatatgatcattctaagctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaagaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatagattcaacttatcagtatataaaaggttctgctgacattaaatccaaccagggaatcttcccctgtggacttcagtgtgtcaccattttaattggtgtctatgacatacagacaggggttcccctgatgggagtcatcaatcaaccttttgtgtcacgagatccaaacaccctcaggtggaaaggacagtgctattggggcctttcttacatggggaccaacatgcattcactacagctcaccatctctagaagaaacggcagtgaaacacacactggaaacaccggctctgaggcagcattctcccccagtttttcagccgtaattagtacaagtgaaaaggagactatcaaagctgcattgtcacgtgtgtgtggagatcgcatatttggggcagctggggctggttataagagcctatgtgttgtccaaggcctcgttgacatttacatcttttcagaagataccacattcaaatgggactcttgtgctgctcatgccatactgcgggccatgggtgggggaatagtagacttgaaagaatgcttagaaagaaatccagaaacagggcttgatttgccacagttggtgtaccacgtggaaaatgagggtgctgctggggtggatcggtgggccaacaagggaggactcattgcatacagatccaggaagcggctggagacattcctgagcctcctggtccaaaacctggcacctgcagagacgcatacctagaggaactctaaccccggtgtacctgtataaactgaactgtgaaactgtttcggttatctctgtcttttgaggatggctttgtcctgttgctggttaacattcaccttcctcttttgaggagtatttttccattatgtattcataataatgttaatttcaataaatgacattcatgcagcaatta

SEQ ID NO: 437280 - DNA, 1985 bp, Homo sapiens
ggaaacagcagccgtggccaagctgaccccagagcccttcccttcctggccctccctctgaatcatcgcgctccacttgtgacgtcgcggacgcccggctcgggcaggcgtggggggcccgcgcgtcccgggagccccgaggcggcagcgcgcgtttccacgccgcggtcccgcgggaaagccgggggcggcggcctggctgaggccaagctcggatccggtgccgagccaagcggggccgtgcgtcgccggggcttcgccttcgctcgcgtgacctccgccgtcctccccaaccctcgtcctctggccgcgcctgcggccgcacgcccagcgcccctcgcctaacctcgcgcccgggccgcgcctcctcctcctcctgctccccgccgcttccgtttctcgagggaaaggctgctgcctcctgctctgtcctcatccccggcttagctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaagaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatagattcaacttatcagtatataaaaggttctgctgacattaaatccaaccagggaatcttcccctgtggacttcagtgtgtcaccattttaattggtgtctatgacatacagacaggggttcccctgatgggagtcatcaatcaaccttttgtgtcacgagatccaaacaccctcaggtggaaaggacagtgctattggggcctttcttacatggggaccaacatgcattcactacagctcaccatctctagaagaaacggcagtgaaacacacactggaaacaccggctctgaggcagcattctcccccagtttttcagccgtaattagtacaagtgaaaaggagactatcaaagctgcattgtcacgtgtgtgtggagatcgcatatttggggcagctggggctggttataagagcctatgtgttgtccaaggcctcgttgacatttacatcttttcagaagataccacattcaaatgggactcttgtgctgctcatgccatactgcgggccatgggtgggggaatagtagacttgaaagaatgcttagaaagaaatccagaaacagggcttgatttgccacagttggtgtaccacgtggaaaatgagggtgctgctggggtggatcggtgggccaacaagggaggactcattgcatacagatccaggaagcggctggagacattcctgagcctcctggtccaaaacctggcacctgcagagacgcatacctagaggaactctaaccccggtgtacctgtataaactgaactgtgaaactgtttcggttatctctgtcttttgaggatggctttgtcctgttgctggttaacattcaccttcctcttttgaggagtatttttccattatgtattcataataatgttaatttcaataaatgacattcatgcagcaattatattggtgtatgaaattcttacagtgaatattgtgctgttagtgctgcttgaaacatttcaataaaatattgaccaggaaaagtggctca

SEQ ID NO: 437281 - DNA, 1666 bp, Homo sapiens
ggaaacagcagccgtggccaagctgaccccagagcccttcccttcctggccctccctctgaatcatcgcgctccacttgtgacgtcgcggacgcccggctcgggcaggcgtggggggcccgcgcgtcccgggagccccgaggcggcagcgcgcgtttccacgccgcggtcccgcgggaaagccgggggcggcggcctggctgaggccaagctcggatccggtgccgagccaagcggggccgtgcgtcgccggggcttcgccttcgctcgcgtgacctccgccgtcctccccaaccctcgtcctctggccgcgcctgcggccgcacgcccagcgcccctcgcctaacctcgcgcccgggccgcgcctcctcctcctcctgctccccgccgcttccgtttctcgagggaaaggctgctgcctcctgctctgtcctcatccccggcttagctgacggcccagagggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagacgctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaagaaacagcagagcttcttagcaaagtcctcaatggtaacaaggtggcatctgaagcattagccagggttgttcatcaggatgttgcctttactgacccaactctggattccacagagatcaatgttccacaggacattttgggaatttgggtggaccccatagattcaacttatcagtatataaaaggttctgctgacattaaatccaaccagggaatcttcccctgtggacttcagtgtgtcaccattttaattggtgtctatgacatacagacaggggttcccctgatgggagtcatcaatcaaccttttgtgtcacgagatccaaacaccctcaggtggaaaggacagtgctattggggcctttcttacatggggaccaacatgcattcactacagctcaccatctctagaagaaacggcagtgaaacacacactggaaacaccggctctgaggcagcattctcccccagtttttcagccgtaattagtacaagtgaaaaggagactatcaaagctgcattgtcacgtgtgtgtggagatcgcatatttggggcagctggggctggttataagagcctatgtgttgtccaaggcctcgttgacatttacatcttttcagaagataccacattcaaatgggactcttgtgctgctcatgccatactgcgggccatgggtgggggaatagtagacttgaaagaatgcttagaaagaaatccagaaacagggcttgatttgccacagttggtgtaccacgtggaaaatgagggtgctgctggggtggatcgtacctgagcctcccggtactggaaactgtttcggtatccgtgtcctgtgcagtgtgcttcc

SEQ ID NO: 437282 - DNA, 265 bp, Homo sapiens
aggcggtggttgcagtgagctgaaatcacaccactgcactccagcctgggtgacagaacgagactccatctcaaaaaaaaaaaagaaaaaagaaaacaagagaaccttgaggattttggtatgtcaaaaatttggctataaggatgtggggtttattacacaactgatgtgtttagatagtttataacaaactgcttctgtgaaaattacaactgatggggaacaggaagagaaaattatcaggaaaggaaagcaggaaagatca

SEQ ID NO: 437283 - DNA, 1096 bp, Homo sapiens
acgcaaagcccggaggcgcgcgcgaccggcggctctttggcgcggattagggggtctcggcgagggagtcatcaagctttggtgtatgtgttggccggttctgaagtcttgaagaagctctgctgaggaagaccaaagcagcactcgttgccaattagggaatggaccgtttgggttcctttagcaatgatccctctgataagccaccttgccgaggctgctcctcctacctcatggagccttatatcaagtgtgctgaatgtgggccacctccttttttcctctgcttgcagtgtttcactcgaggctttgagtacaagaaacatcaaagcgatcatacttatgaaataatgacttcagattttcctgtccttgatcccagctggactgctcaagaagaaatggcccttttagaagctgtgatggactgtggctttggaaattggcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactctacagatgaccctccccgacctacctttgactccttgctttctcgggacatggccgggtacatgccagctcgagcagatttcattgaggaatttgacaattatgcagaatgggacttgagagacattgattttgttgaagatgactcggacattttacatgctctgaagatggctgtggtagatatctatcattccaggttaaaggagagacaaagacgaaaaaaaattataagagaccatggattaatcaaccttagaaagtttcaattaatggaacggcggtatcccaaggaggtccaggacctgtatgaaacaatgaggcgatttgcaagaattgtggggccagtggaacatgacaaattcattgaaagccatgcatgtaggtggtttttgagccttgagcagtatttgtgtgtgtatatttatataaataggagagataatggtgtgttttatgtgaagttctataaataaataaatggatatttctc

SEQ ID NO: 437284 - DNA, 2527 bp, Homo sapiens
atttttcccgctcagccctggagcgcgtagctctaccaagaatggccactgtgccagatgcccctgaccagcgttgcccatttgaatttcctagcaggccccccaaagtaggtatttcagtaccctgttagagctgaggcgcaggtaaaatgactggcccaggccggtcccaccccgtaaggatttgaacgttggctccacaactcgggagcctgcgcctttcctcctcccaacgtggactcctgcccggcgaagtgcctcacttccttctcccgggagtcatcaagctttggtgtatgtgttggccggttctgaagtcttgaagaagctctgctgaggaagaccaaagcagcactcgttgccaattagggaatggaccgtttgggttcctttagcaatgatccctctgataagccaccttgccgaggctgctcctcctacctcatggagccttatatcaagtgtgctgaatgtgggccacctccttttttcctctgcttgcagtgtttcactcgaggctttgagtacaagaaacatcaaagcgatcatacttatgaaataatgacttcagattttcctgtccttgatcccagctggactgctcaagaagaaatggcccttttagaagctgtgatggactgtggctttggaaattggcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactctacagatgaccctccccgacctacctttgactccttgctttctcgggacatggccgggtacatgccagctcgagcagatttcattgaggaatttgacaattatgcagaatgggacttgagagacattgattttgttgaagatgactcggacattttacatgctctgaagatggctgtggtagatatctatcattccaggttaaaggagagacaaagacgaaaaaaaattataagagaccatggattaatcaaccttagaaagtttcaattaatggaacggcggtatcccaaggaggtccaggacctgtatgaaacaatgaggcgatttgcaagaattgtggggccagtggaacatgacaaattcattgaaagccatgcattggaatttgaactccgaagggaaatcaagaggctccaagaatacaggacagcaggcattaccaatttttgtagtgccagaacctacgatcacctcaagaagacacgggaggaagagcgccttaaacgcactatgctctcagaagttctccagtatatccaggacagtagtgcttgccagcagtggctccgccggcaagctgacattgattccggcctgagtccttccattccaatggcttcgaattcaggtagacggagtgcaccacccttgaacctcactggcctccctggcacagagaagctgaatgaaaaagaaaaggagctctgtcagatggtgaggttggtccctggagcctatttagaatacaaatctgctctattgaacgaatgtaacaagcaaggaggcttaagactggcgcaggcaagagcactcatcaagatagatgtgaacaaaacccggaaaatctatgatttcctcatcagagaaggatacatcactaaaggctaaggctccaagagcttgggatcagaagtcagaagtttggaatgtggtgggtcaaaggacaatatgggtgggcattctggagagttgtttttcagctgaattctcatggtgaaaacaggggaaaggacaaaggaaaccttaagttgtattgtctactttcttctccatcctgctttaaaacactcctgttgttggtattatgctgcagagttgtgtgctacataagctattattaaatgtgagtgggcattcattcctaacacctcttgtaactaaaagaaccatagtacctcacatcacagtgctggtagaaatggaactaaaccacagtctgtaatcccaggagtccagctcagatccttatattgcgaggtaagtttgctgattatctgtcttgccttcaaacactgcagacagatttaaaataaagagaaaggttttagagcataagaaagctctcgttgaaggattttttaagctgacaactttttttttttttttttgagacagagtttgctcttgtcctccaggctggagtgtgatggcaagatctcagctcactacaacctctgcctcccaggagaattgcttgaacacaggaggcagaggttgcagcgagctgagatcacgccactgtgctccagcctgggcaacaaagtgagactctgtctcaaaaaaaaaaaaacaaaaaaaaacctttaatgtctggctttgtactttgcagtctgcctgtctaatctgcagtagtcttttgaggaggtggcaccggatataacatgtctctgttatttttagaattaattaaaatgttttgctatttaatttg

SEQ ID NO: 437285 - DNA, 2782 bp, Homo sapiens
acgcaaagcccggaggcgcgcgcgaccggcggctctttggcgcggattagggggtctcggcgagggagtcatcaagctttggtgtatgtgttggccggttctgaagtcttgaagaagctctgctgaggaagaccaaagcagcactcgttgccaattagggaatggaccgtttgggttcctttagcaatgatccctctgataagccaccttgccgaggctgctcctcctacctcatggagccttatatcaagtgtgctgaatgtgggccacctccttttttcctctgcttgcagtgtttcactcgaggctttgagtacaagaaacatcaaagcgatcatacttatgaaataatgacttcagattttcctgtccttgatcccagctggactgctcaagaagaaatggcccttttagaagctgtgatggactgtggctttggaaattggcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactctacagatgaccctccccgacctacctttgactccttgctttctcgggacatggccgggtacatgccagctcgagcagatttcattgaggaatttgacaattatgcagaatgggacttgagagacattgattttgttgaagatgactcggacattttacatgctctgaagatggctgtggtagatatctatcattccaggttaaaggagagacaaagacgaaaaaaaattataagagaccatggattaatcaaccttagaaagtttcaattaatggaacggcggtatcccaaggaggtccaggacctgtatgaaacaatgaggcgatttgcaagaattgtggggccagtggaacatgacaaattcattgaaagccatgcattggaatttgaactccgaagggaaatcaagaggctccaagaatacaggacagcaggcattaccaatttttgtagtgccagaacctacgatcacctcaagaagacacgggaggaagagcgccttaaacgcactatgctctcagaagttctccagtatatccaggacagtagtgcttgccagcagtggctccgccggcaagctgacattgattccggcctgagtccttccattccaatggcttcgaattcaggtagacggagtgcaccacccttgaacctcactggcctccctggcacagagaagctgaatgaaaaagaaaaggagctctgtcagatggtgaggttggtccctggagcctatttagaatacaaatctgctctattgaacgaatgtaacaagcaaggaggcttaagactggcgcaggcaagagcactcatcaagatagatgtgaacaaaacccggaaaatctatgatttcctcatcagagaaggatacatcactaaaggctaaggctccaagagcttgggatcagaagtcagaagtttggaatgtggtgggtcaaaggacaatatgggtgggcattctggagagttgtttttcagctgaattctcatggtgaaaacaggggaaaggacaaaggaaaccttaagttgtattgtctactttcttctccatcctgctttaaaacactcctgttgttggtattatgctgcagagttgtgtgctacataagctattattaaatgtgagtgggcattcattcctaacacctcttgtaactaaaagaaccatagtacctcacatcacagtgctggtagaaatggaactaaaccacagtctgtaatcccaggagtccagctcagatccttatattgcgaggtaagtttgctgattatctgtcttgccttcaaacactgcagacagatttaaaataaagagaaaggttttagagcataagaaagctctcgttgaaggattttttaagctgacaactttttttttttttttttgagacagagtttgctcttgtcctccaggctggagtgtgatggcaagatctcagctcactacaacctctgcctcccaggttcaagtgattctcctgcctcagcctcccgaatagctgggactacaggtgtccaccaccacacctggctaattttgtatttttagtagagacagggttttgtcatgttggccaggctggtcacaaactcctgacctcaggtgatctgcccgcctcagcctcccaaagtactaggattacaggcgtgagccatcgcgcccggcctaagctgacaacttttatgagtaaaggggaagaaaatatccttatgatggtcttatcccaaactgcatctttaacttcggccgggcaaggtggctcgcctgtaatcccagcactttgggaggctgaggtgggcggatcacgaagtcaggagttcaagaccagcctgaccaacatggtgaaacagtctctactggaaatacaaaaattagctgagtgtggtggcacacgcctgtagtcccagctactcgggaggctgaggcaggagaattgcttgaacacaggaggcagaggttgcagcgagctgagatcacgccactgtgctccagcctgggcaacaaagtgagactctgtctcaaaaaaaaaaaaacaaaaaaaaacctttaatgtctggctttgtactttgcagtctgcctgtctaatctgcagtagtcttttgaggaggtggcaccggatataacatgtctctgttatttttagaattaattaaaatgttttgctatttaatttg

SEQ ID NO: 437286 - DNA, 3002 bp, Homo sapiens
agtgcaatggcgccatctcaacacactgcaacttctgcctcccaggttcaagcgattctcctgcctcagcctcccaagtagctggattacaggcatacgccaccacgcccagctaattttgtatttttagtagagacagggtttctacatgttggtcaggctgatctcgaactgccgacttcaggtgatctgcctgcctcggcctgctaaagtgctgggattacaggcgtgagccactgcgtccagccttgacatctgtatttgaaatgacacagctatcccttggagtcatcaagctttggtgtatgtgttggccggttctgaagtcttgaagaagctctgctgaggaagaccaaagcagcactcgttgccaattagggaatggaccgtttgggttcctttagcaatgatccctctgataagccaccttgccgaggctgctcctcctacctcatggagccttatatcaagtgtgctgaatgtgggccacctccttttttcctctgcttgcagtgtttcactcgaggctttgagtacaagaaacatcaaagcgatcatacttatgaaataatgacttcagattttcctgtccttgatcccagctggactgctcaagaagaaatggcccttttagaagctgtgatggactgtggctttggaaattggcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactctacagatgaccctccccgacctacctttgactccttgctttctcgggacatggccgggtacatgccagctcgagcagatttcattgaggaatttgacaattatgcagaatgggacttgagagacattgattttgttgaagatgactcggacattttacatgctctgaagatggctgtggtagatatctatcattccaggttaaaggagagacaaagacgaaaaaaaattataagagaccatggattaatcaaccttagaaagtttcaattaatggaacggcggtatcccaaggaggtccaggacctgtatgaaacaatgaggcgatttgcaagaattgtggggccagtggaacatgacaaattcattgaaagccatgcattggaatttgaactccgaagggaaatcaagaggctccaagaatacaggacagcaggcattaccaatttttgtagtgccagaacctacgatcacctcaagaagacacgggaggaagagcgccttaaacgcactatgctctcagaagttctccagtatatccaggacagtagtgcttgccagcagtggctccgccggcaagctgacattgattccggcctgagtccttccattccaatggcttcgaattcaggtagacggagtgcaccacccttgaacctcactggcctccctggcacagagaagctgaatgaaaaagaaaaggagctctgtcagatggtgaggttggtccctggagcctatttagaatacaaatctgctctattgaacgaatgtaacaagcaaggaggcttaagactggcgcaggcaagagcactcatcaagatagatgtgaacaaaacccggaaaatctatgatttcctcatcagagaaggatacatcactaaaggctaaggctccaagagcttgggatcagaagtcagaagtttggaatgtggtgggtcaaaggacaatatgggtgggcattctggagagttgtttttcagctgaattctcatggtgaaaacaggggaaaggacaaaggaaaccttaagttgtattgtctactttcttctccatcctgctttaaaacactcctgttgttggtattatgctgcagagttgtgtgctacataagctattattaaatgtgagtgggcattcattcctaacacctcttgtaactaaaagaaccatagtacctcacatcacagtgctggtagaaatggaactaaaccacagtctgtaatcccaggagtccagctcagatccttatattgcgaggtaagtttgctgattatctgtcttgccttcaaacactgcagacagatttaaaataaagagaaaggttttagagcataagaaagctctcgttgaaggattttttaagctgacaactttttttttttttttttgagacagagtttgctcttgtcctccaggctggagtgtgatggcaagatctcagctcactacaacctctgcctcccaggttcaagtgattctcctgcctcagcctcccgaatagctgggactacaggtgtccaccaccacacctggctaattttgtatttttagtagagacagggttttgtcatgttggccaggctggtcacaaactcctgacctcaggtgatctgcccgcctcagcctcccaaagtactaggattacaggcgtgagccatcgcgcccggcctaagctgacaacttttatgagtaaaggggaagaaaatatccttatgatggtcttatcccaaactgcatctttaacttcggccgggcaaggtggctcgcctgtaatcccagcactttgggaggctgaggtgggcggatcacgaagtcaggagttcaagaccagcctgaccaacatggtgaaacagtctctactggaaatacaaaaattagctgagtgtggtggcacacgcctgtagtcccagctactcgggaggctgaggcaggagaattgcttgaacacaggaggcagaggttgcagcgagctgagatcacgccactgtgctccagcctgggcaacaaagtgagactctgtctcaaaaaaaaaaaaacaaaaaaaaacctttaatgtctggctttgtactttgcagtctgcctgtctaatctgcagtagtcttttgaggaggtggcaccggatataacatgtctctgttatttttagaattaattaaaatgttttgctatttaatttg

SEQ ID NO: 437287 - DNA, 2911 bp, Homo sapiens
acgcaaagcccggaggcgcgcgcgaccggcggctctttggcgcggattagggggtctcggcgagggagtcatcaagctttggtgtatgtgttggccggttctgaagtcttgaagaagctctgctgaggaagaccaaagcagcactcgttgccaattagggaatggaccgtttgggttcctttagcaatgatccctctgataagccaccttgccgaggctgctcctcctacctcatggagccttatatcaagtgtgctgaatgtgggccacctccttttttcctctgcttgcagtgtttcactcgaggctttgagtacaagaaacatcaaagcgatcatacttatgaaataatgacttcagattttcctgtccttgatcccagctggactgctcaagaagaaatggcccttttagaagctgtgatggactgtggctttggaaattggtaagagcttggtgttaagagttgtcctgccctagtggactcagagaagaagctgttgttgaagagtaaaggaaggaacctcaggaagagaaagtatgtgttgctttcctatcaacccatgatttagaggcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactctacagatgaccctccccgacctacctttgactccttgctttctcgggacatggccgggtacatgccagctcgagcagatttcattgaggaatttgacaattatgcagaatgggacttgagagacattgattttgttgaagatgactcggacattttacatgctctgaagatggctgtggtagatatctatcattccaggttaaaggagagacaaagacgaaaaaaaattataagagaccatggattaatcaaccttagaaagtttcaattaatggaacggcggtatcccaaggaggtccaggacctgtatgaaacaatgaggcgatttgcaagaattgtggggccagtggaacatgacaaattcattgaaagccatgcattggaatttgaactccgaagggaaatcaagaggctccaagaatacaggacagcaggcattaccaatttttgtagtgccagaacctacgatcacctcaagaagacacgggaggaagagcgccttaaacgcactatgctctcagaagttctccagtatatccaggacagtagtgcttgccagcagtggctccgccggcaagctgacattgattccggcctgagtccttccattccaatggcttcgaattcaggtagacggagtgcaccacccttgaacctcactggcctccctggcacagagaagctgaatgaaaaagaaaaggagctctgtcagatggtgaggttggtccctggagcctatttagaatacaaatctgctctattgaacgaatgtaacaagcaaggaggcttaagactggcgcaggcaagagcactcatcaagatagatgtgaacaaaacccggaaaatctatgatttcctcatcagagaaggatacatcactaaaggctaaggctccaagagcttgggatcagaagtcagaagtttggaatgtggtgggtcaaaggacaatatgggtgggcattctggagagttgtttttcagctgaattctcatggtgaaaacaggggaaaggacaaaggaaaccttaagttgtattgtctactttcttctccatcctgctttaaaacactcctgttgttggtattatgctgcagagttgtgtgctacataagctattattaaatgtgagtgggcattcattcctaacacctcttgtaactaaaagaaccatagtacctcacatcacagtgctggtagaaatggaactaaaccacagtctgtaatcccaggagtccagctcagatccttatattgcgaggtaagtttgctgattatctgtcttgccttcaaacactgcagacagatttaaaataaagagaaaggttttagagcataagaaagctctcgttgaaggattttttaagctgacaactttttttttttttttttgagacagagtttgctcttgtcctccaggctggagtgtgatggcaagatctcagctcactacaacctctgcctcccaggttcaagtgattctcctgcctcagcctcccgaatagctgggactacaggtgtccaccaccacacctggctaattttgtatttttagtagagacagggttttgtcatgttggccaggctggtcacaaactcctgacctcaggtgatctgcccgcctcagcctcccaaagtactaggattacaggcgtgagccatcgcgcccggcctaagctgacaacttttatgagtaaaggggaagaaaatatccttatgatggtcttatcccaaactgcatctttaacttcggccgggcaaggtggctcgcctgtaatcccagcactttgggaggctgaggtgggcggatcacgaagtcaggagttcaagaccagcctgaccaacatggtgaaacagtctctactggaaatacaaaaattagctgagtgtggtggcacacgcctgtagtcccagctactcgggaggctgaggcaggagaattgcttgaacacaggaggcagaggttgcagcgagctgagatcacgccactgtgctccagcctgggcaacaaagtgagactctgtctcaaaaaaaaaaaaacaaaaaaaaacctttaatgtctggctttgtactttgcagtctgcctgtctaatctgcagtagtcttttgaggaggtggcaccggatataacatgtctctgttatttttagaattaattaaaatgttttgctatttaatttg

SEQ ID NO: 437288 - DNA, 1259 bp, Homo sapiens
atttttcccgctcagccctggagcgcgtagctctaccaagaatggccactgtgccagatgcccctgaccagcgttgcccatttgaatttcctagcaggccccccaaagtaggtatttcagtaccctgttagagctgaggcgcaggtaaaatgactggcccaggccggtcccaccccgtaaggatttgaacgttggctccacaactcgggagcctgcgcctttcctcctcccaacgtggactcctgcccggcgaagtgcctcacttccttctcccgggagtcatcaagctttggtgtatgtgttggccggttctgaagtcttgaagaagctctgctgaggaagaccaaagcagcactcgttgccaattagggaatggaccgtttgggttcctttagcaatgatccctctgataagccaccttgccgaggctgctcctcctacctcatggagccttatatcaagtgtgctgaatgtgggccacctccttttttcctctgcttgcagtgtttcactcgaggctttgagtacaagaaacatcaaagcgatcatacttatgaaataatgacttcagattttcctgtccttgatcccagctggactgctcaagaagaaatggcccttttagaagctgtgatggactgtggctttggaaattggcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactgtaagtgcctccctatcttgataagatatacttagctcatccttgggccctgtttcagtagcagataaagagtgatttgatgacttggacagctaatgatatcacggaagataggaggagttagtatggcagctattgagagtcaggatcgacccagcatggtggcttgtgcctgtggtcccagcaccttgggaggctgaggcgggtaaatcacttgaggccaggagttcaagaccagcctggccaacatggcgaaaccctgtctcaactaaaagtataaagattagctggacgtggtggcagacacctgtaatcccagctactggggaggccaaggcaggagaatcacttgaaccgggtaggcggagattgcagtgagccaagatcacatcactgcactccaacctgggtgacagagtgagacttcatctcttaaaaaaaaaaa

SEQ ID NO: 437289 - DNA, 830 bp, Homo sapiens
agtgcaatggcgccatctcaacacactgcaacttctgcctcccaggttcaagcgattctcctgcctcagcctcccaagtagctggattacaggcatacgccaccacgcccagctaattttgtatttttagtagagacagggtttctacatgttggtcaggctgatctcgaactgccgacttcaggtgatctgcctgcctcggcctgctaaagtgctgggattacaggcgtgagccactgcgtccagccttgacatctgtatttgaaatgacacagctatcccttggagtcatcaagctttggtgtatgtgttggccggttctgaagtcttgaagaagctctgctgaggaagaccaaagcagcactcgttgccaattagggaatggaccgtttgggttcctttagcaatgatccctctgataagccaccttgccgaggctgctcctcctacctcatggagccttatatcaagtgtgctgaatgtgggccacctccttttttcctctgcttgcagctgcagacaagattaaatgaatccttaaaaaattgttgtccgggctcggtggctcacgcctgtaatcccagcactttgggaggccaagaaaggtgaatcacaagatcaggagttcgaggccagcctggccaaggtggtgaaatcccgtctctgctaaaaatacgaaaattagctgagtgttgtgccggctgcctgtaatcccagctactcgagaggctgaagcaggagaatcaacttgaacctgggaggcagaggttgcagtgagctgagatggcgccactctagcctgggtgaaagagcaagactccgtctcagaa

SEQ ID NO: 437290 - DNA, 411 bp, Homo sapiens
atatcaatttggaaatatgagagtatattatatggatgtgacttaaaatatgaaaagagcaaatgatgcttttagtattatgtgtaaatacaagtaccacttctctctttttcccacaatcctctaggcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactgtaagtgcctccctatcttgataagatatacttagctcatccttgggccctgtttcagtagcagataaagagtgatttgatgacttggacagctaatgatatcacggaagataggaggagttagta

SEQ ID NO: 437291 - DNA, 2993 bp, Homo sapiens
atttttcccgctcagccctggagcgcgtagctctaccaagaatggccactgtgccagatgcccctgaccagcgttgcccatttgaatttcctagcaggccccccaaagtaggtatttcagtaccctgttagagctgaggcgcaggtaaaatgactggcccaggccggtcccaccccgtaaggatttgaacgttggctccacaactcgggagcctgcgcctttcctcctcccaacgtggactcctgcccggcgaagtgcctcacttccttctcccgggagtcatcaagctttggtgtatgtgttggccggttctgaagtcttgaagaagctctgctgaggaagaccaaagcagcactcgttgccaattagggaatggaccgtttgggttcctttagcaatgatccctctgataagccaccttgccgaggctgctcctcctacctcatggagccttatatcaagtgtgctgaatgtgggccacctccttttttcctctgcttgcagtgtttcactcgaggctttgagtacaagaaacatcaaagcgatcatacttatgaaataatgacttcagattttcctgtccttgatcccagctggactgctcaagaagaaatggcccttttagaagctgtgatggactgtggctttggaaattggcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactctacagatgaccctccccgacctacctttgactccttgctttctcgggacatggccgggtacatgccagctcgagcagatttcattgaggaatttgacaattatgcagaatgggacttgagagacattgattttgttgaagatgactcggacattttacatgctctgaagatggctgtggtagatatctatcattccaggttaaaggagagacaaagacgaaaaaaaattataagagaccatggattaatcaaccttagaaagtttcaattaatggaacggcggtatcccaaggaggtccaggacctgtatgaaacaatgaggcgatttgcaagaattgtggggccagtggaacatgacaaattcattgaaagccatgcattggaatttgaactccgaagggaaatcaagaggctccaagaatacaggacagcaggcattaccaatttttgtagtgccagaacctacgatcacctcaagaagacacgggaggaagagcgccttaaacgcactatgctctcagaagttctccagtatatccaggacagtagtgcttgccagcagtggctccgccggcaagctgacattgattccggcctgagtccttccattccaatggcttcgaattcaggtagacggagtgcaccacccttgaacctcactggcctccctggcacagagaagctgaatgaaaaagaaaaggagctctgtcagatggtgaggttggtccctggagcctatttagaatacaaatctgctctattgaacgaatgtaacaagcaaggaggcttaagactggcgcaggcaagagcactcatcaagatagatgtgaacaaaacccggaaaatctatgatttcctcatcagagaaggatacatcactaaaggctaaggctccaagagcttgggatcagaagtcagaagtttggaatgtggtgggtcaaaggacaatatgggtgggcattctggagagttgtttttcagctgaattctcatggtgaaaacaggggaaaggacaaaggaaaccttaagttgtattgtctactttcttctccatcctgctttaaaacactcctgttgttggtattatgctgcagagttgtgtgctacataagctattattaaatgtgagtgggcattcattcctaacacctcttgtaactaaaagaaccatagtacctcacatcacagtgctggtagaaatggaactaaaccacagtctgtaatcccaggagtccagctcagatccttatattgcgaggtaagtttgctgattatctgtcttgccttcaaacactgcagacagatttaaaataaagagaaaggttttagagcataagaaagctctcgttgaaggattttttaagctgacaactttttttttttttttttgagacagagtttgctcttgtcctccaggctggagtgtgatggcaagatctcagctcactacaacctctgcctcccaggttcaagtgattctcctgcctcagcctcccgaatagctgggactacaggtgtccaccaccacacctggctaattttgtatttttagtagagacagggttttgtcatgttggccaggctggtcacaaactcctgacctcaggtgatctgcccgcctcagcctcccaaagtactaggattacaggcgtgagccatcgcgcccggcctaagctgacaacttttatgagtaaaggggaagaaaatatccttatgatggtcttatcccaaactgcatctttaacttcggccgggcaaggtggctcgcctgtaatcccagcactttgggaggctgaggtgggcggatcacgaagtcaggagttcaagaccagcctgaccaacatggtgaaacagtctctactggaaatacaaaaattagctgagtgtggtggcacacgcctgtagtcccagctactcgggaggctgaggcaggagaattgcttgaacacaggaggcagaggttgcagcgagctgagatcacgccactgtgctccagcctgggcaacaaagtgagactctgtctcaaaaaaaaaaaaacaaaaaaaaacctttaatgtctggctttgtactttgcagtctgcctgtctaatctgcagtagtcttttgaggaggtggcaccggatataacatgtctctgttatttttagaattaattaaaatgttttgctatttaatttg

SEQ ID NO: 437292 - DNA, 2457 bp, Homo sapiens
atttttcccgctcagccctggagcgcgtagctctaccaagaatggccactgtgccagatgcccctgaccagcgttgcccatttgaatttcctagcaggccccccaaagtaggtatttcagtaccctgttagagctgaggcgcaggtaaaatgactggcccaggccggtcccaccccgtaaggatttgaacgttggctccacaactcgggagcctgcgcctttcctcctcccaacgtggactcctgcccggcgaagtgcctcacttccttctcccgggagtcatcaagctttggtgtatgtgttggccggttctgaagtcttgaagaagctctgctgaggaagaccaaagcagcactcgttgccaattagggaatggaccgtttgggttcctttagcaatgatccctctgataagccaccttgccgaggctgctcctcctacctcatggagccttatatcaagtgtgctgaatgtgggccacctccttttttcctctgcttgcagtgtttcactcgaggctttgagtacaagaaacatcaaagcgatcatacttatgaaataatgacttcagattttcctgtccttgatcccagctggactgctcaagaagaaatggcccttttagaagctgtgatggactgtggctttggaaattggcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactctacagatgaccctccccgacctacctttgactccttgctttctcgggacatggccgggtacatgccagctcgagcagatttcattgaggaatttgacaattatgcagaatgggacttgagagacattgattttgttgaagatgactcggacattttacatgctctgaagatggctgtggtagatatctatcattccaggttaaaggagagacaaagacgaaaaaaaattataagagaccatggattaatcaaccttagaaagtttcaattaatggaacggcggtatcccaaggaggtccaggacctgtatgaaacaatgaggcgatttgcaagaattgtggggccagtggaacatgacaaattcattgaaagccatgcattggaatttgaactccgaagggaaatcaagaggctccaagaatacaggacagcaggcattaccaatttttgtagtgccagaacctacgatcacctcaagaagacacgggaggaagagcgccttaaacgcactatgctctcagaagttctccagtatatccaggacagtagtgcttgccagcagtggctccgccggcaagctgacattgattccggcctgagtccttccattccaatggcttcgaattcaggtagacggagtgcaccacccttgaacctcactggcctccctggcacagagaagctgaatgaaaaagaaaaggagctctgtcagatggtgaggttggtccctggagcctatttagaatacaaatctgctctattgaacgaatgtaacaagcaaggaggcttaagactggcgcaggcaagagcactcatcaagatagatgtgaacaaaacccggaaaatctatgatttcctcatcagagaaggatacatcactaaaggctaaggctccaagagcttgggatcagaagtcagaagtttggaatgtggtgggtcaaaggacaatatgggtgggcattctggagagttgtttttcagctgaattctcatggtgaaaacaggggaaaggacaaaggaaaccttaagttgtattgtctactttcttctccatcctgctttaaaacactcctgttgttggtattatgctgcagagttgtgtgctacataagctattattaaatgtgagtgggcattcattcctaacacctcttgtaactaaaagaaccatagtacctcacatcacagtgctggtagaaatggaactaaaccacagtctgtaatcccaggagtccagctcagatccttatattgcgaggtaagtttgctgattatctgtcttgccttcaaacactgcagacagatttaaaataaagagaaaggttttagagcataagaaagctctcgttgaaggattttttaagctgacaactttttttttttttttttgagacagagtttgctcttgtcctccaggctggaaggttgcagcgagctgagatcacgccactgtgctccagcctgggcaacaaagtgagactctgtctcaaaaaaaaaaaaacaaaaaaaaacctttaatgtctggctttgtactttgcagtctgcctgtctaatctgcagtagtcttttgaggaggtggcaccggatataacatgtctctgttatttttagaattaattaaaatgttttgctatttaatttg

SEQ ID NO: 437293 - DNA, 1519 bp, Homo sapiens
acgcaaagcccggaggcgcgcgcgaccggcggctctttggcgcggattagggggtctcggcgagggagtcatcaagctttggtgtatgtgttggccggttctgaagtcttgaagaagctctgctgaggaagaccaaagcagcactcgttgccaattagggaatggaccgtttgggttcctttagcaatgatccctctgataagccaccttgccgaggctgctcctcctacctcatggagccttatatcaagtgtgctgaatgtgggccacctccttttttcctctgcttgcagtgtttcactcgaggctttgagtacaagaaacatcaaagcgatcatacttatgaaataatgacttcagattttcctgtccttgatcccagctggactgctcaagaagaaatggcccttttagaagctgtgatggactgtggctttggaaattggcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactctacagatgaccctccccgacctacctttgactccttgctttctcgggacatggccgggtacatgccagctcgagcagatttcattgaggaatttgacaattatgcagaatgggacttgagagacattgattttgttgaagatgactcggacattttacatgctctgaagatggctgtggtagatatctatcattccaggttaaaggagagacaaagacgaaaaaaaattataagagaccatggattaatcaaccttagaaagtttcaattaatggaacggcggtatcccaaggaggtccaggacctgtatgaaacaatgaggcgatttgcaagaattgtggggccagtggaacatgacaaattcattgaaagccatgcattggaatttgaactccgaagggaaatcaagaggctccaagaatacaggacagcaggcattaccaatttttgtagtgccagaacctacgatcacctcaagaagacacgggaggaagagcgccttaaacgcactatgctctcagaagttctccagtatatccaggacagtagtgcttgccagcagtggctccgccggcaagctgacattgattccggcctgagtccttccattccaatggcttcgaattcaggtagacggagtgcaccacccttgaacctcactggcctccctggcacagagaagctgaatgaaaaagaaaaggagctctgtcagatggtgaggttggtccctggagcctatttagaatacaaatctgctctattgaacgaatgtaacaagcaaggaggcttaagactggcgcaggcaagagcactcatcaagatagatgtgaacaaaacccggaaaatctatgatttcctcatcagagaaggatacatcactaaagaattaattaaaatgttttgctatttaatttg

SEQ ID NO: 437294 - DNA, 983 bp, Homo sapiens
acgcaaagcccggaggcgcgcgcgaccggcggctctttggcgcggattagggggtctcggcgagggagtcatcaagctttggtgtatgtgttggccggttctgaagtcttgaagaagctctgctgaggaagaccaaagcagcactcgttgccaattagggaatggaccgtttgggttcctttagcaatgatccctctgataagccaccttgccgaggctgctcctcctacctcatggagccttatatcaagtgtgctgaatgtgggccacctccttttttcctctgcttgcagtgtttcactcgaggctttgagtacaagaaacatcaaagcgatcatacttatgaaataatgacttcagattttcctgtccttgatcccagctggactgctcaagaagaaatggcccttttagaagctgtgatggactgtggctttggaaattggcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactctacagatgaccctccccgacctacctttgactccttgctttctcgggacatggccgggtacatgccagctcgagcagatttcattgaggaatttgacaattatgcagaatgggacttgagagacattgattttgttgaagatgactcggacattttacatgctctgaagatggctgtggtagatatctatcattccaggttaaaggagagacaaagacgaaaaaaaaaaaaaaaaaaacaaaaaaaaacctttaatgtctggctttgtactttgcagtctgcctgtctaatctgcagtagtcttttgaggaggtggcaccggatataacatgtctctgttatttttagaattaattaaaatgttttgctatttaatttg

SEQ ID NO: 437295 - DNA, 1108 bp, Homo sapiens
caaaggacagcaaaagcactttactgccttagaaggaggggaggctttgccaggcctatgaaaccctcatctggatctggcctccagggcagcctcctgcctgcctctctggtgaggctcagcttctgctctgcctcaccagctcccctccagttcccctcactctgagggtgcagggagcagggtcccacgggagcattggtgtgagagggagctcccagcaccgagggagaagcaggactcactgaccaaaccatgtgtttgtgctggaagggcctcactgcaaacatgctcatcttatggaagaagaaaggaggttcagagagggaaaggcttgcctgaggtcacacggttcctggggatgcagctggagccgggctggtggaagcagcaggccgaagtgttttagaatcttcctgaacccagcaaagggatggcccgctgaatatggactccaacggtgccctaggggatggtggagccaccagatggaaggagcctggtgatcccgagaaggagagatgcctcgctgacctgaacatctttccagaactgttaactacagaaataacgaatgggtactgacagaaggaaaacctgctcaacaagtgaaaaaaagaaaaagcaaaatggtgtatttttaacaaaattatactaagggaatctaaggtaccccttgtagcaatataaaacattacttttggattgtgttttaccatatacaaaatgattgtatgtgtataatttcttttaattctcacagccatgtgaagaatgtatcattactagatgtgcaatgcctttattctctgcagaagctacatcaaaggttctgaatgtgtgctaaccacttacattgtctatacaaataatttcattgtatatcatcacctgtgaacaacatggccaataccagaaccaggagggagaagtgttggttaagtagtacagaaaacccaggtgctcaaaattaatataagaatccatcattatatggtgacttctgatgtgtgagttccagaaatgaaaaaatctaacaataactacagtatgtaaaaagtaaagtaatatatttaagaccaataaaaataaatcagaaatgtatgtt

SEQ ID NO: 437296 - DNA, 859 bp, Homo sapiens
caaaggacagcaaaagcactttactgccttagaaggaggggaggctttgccaggcctatgaaaccctcatctggatctggcctccagggcagcctcctgcctgcctctctggtgaggctcagcttctgctctgcctcaccagctcccctccagttcccctcactctgagggtgcagggagcagggtcccacgggagcattggtgtgagagggagctcccagcaccgagggagaagcaggactcactgaccaaaccatgtgtttgtgctggaagggcctcactgcaaacatgctcatcttatggaagaagaaaggaggttcagagagggaaaggcttgcctgaggtcacacggttcctggggatgcagctggagccgggctggtggaagcagcaggccgaagtgttttagaatcttcctgaacccagcaaagggatggcccgctgaatatggactccaacggtgccctaggggatggtggagccaccagatggaaggagcctggtgatcccgagaaggagagatgcctcgctgacctgaacatctttccagaactgttaaatgaagcctgcaggacaccagctgacagtggaaggactgaggaaggttgtataattttgtgcaaggtccaccacaaatccagctgaagaactgctccaaagtttaggtcatggcaagaacaagactggatcactccatgtcagtggaaacatgtccaccaacttcatcattgtctgttgtcatggttcactttagatgtaaacttgactggattaaggattccctaaagtgtcaggcctctgagcccaagctaagccatcatatcccctgtgacctgcatgtacacatccagatggccgg

SEQ ID NO: 437297 - DNA, 777 bp, Homo sapiens
agtaagggcacatgagaaaacactttaagaacctattcttccaaagatctttccagtatcttatgacaacacagtaaattatacccactccaaatgcaaaagctgaaactactctgctttctcacttacctacacttttgactttcgaaatacatttctctcttcggatatgagctgcaaactccttatataaaggctccaactctgcagccctaattattctagttggcccaagaaaaatcctaattgttttatctaaggagacggaattttccaatactgtagaggcatgtgtgtgtgtttgctttaaggaagctgttttggtaataaaaagtcactgagggtcataaattcatgttaacacatccagtgtacatgaagtaggcaccgagttaaactatttgtctactatatagcatgtcatcttaaaagccttattttttcctcaaaatattaactttatttttctccctgtaaaatcaagacacagttaaaatgtagccttcctcattttctgggaatactttctaacaagatatgcttctttccaattggacttctaaatttctagcaattctaacagtgcataaaagaggcaaccccaaaagtgtagcaggtactgaataacagatttgcagccttgggtatccacattaaaatttgaaatctaagtgaattacttcaagctgatttcttaggtcaaggagagattatggtccttaaatgcctgataaggtcacatacacaatttcaagtgcattatagtaaatccatgtg

SEQ ID NO: 437298 - DNA, 192 bp, Homo sapiens
ggtcaaggagagattatggtccttaaatgcctgataaggtcacatacacaatttcaagtgcattatagtaaatccatgtgacagctcctacagctactaacctgcttccgccctcacggtaacgtgcacaatcttcatcgcatgtcctgggtggtggtaggagcagtagaaaccccctgggtcatgtcagat

SEQ ID NO: 437299 - DNA, 2222 bp, Homo sapiens
ctctaaaagccgcagttagaggcgagatttaggaaaaacctctgccgagtgagcctctggttgggaatatgtatgagaaaaaaaaactggcaaggcgttagtcaagcaaagctgaaggcagaggaaatttgatatctggctggagtctagaggatttaatgcaaataagatactctgagggcagcgtggcaaaaaaagactacaattcccggtggtcacagcgtttgagaagcgatgctttctgagacttgtagtaactaggagctgtgtttgaactatccaggctcaggacagcctcttgaaaaaaaattttttattaataaagcggatttgagtgggatctttttcctaatcgattacgggcccacacgtatgggaagaattctaacaatgattaaagggacatgctacctttacgactatccttttctaatcgatgactcctaaatctaggagtaggtagtcgatgtttgtggtctgggcgtctgtagaagggcaacctcgtgctttctgcagaggagaccggagggcagaaggcagagtccaggcttagactgcagttcctcgcttacctgtgcagtctaattttgagctgcctctttgtagtcttaaaaggcaggagcttcgtgttgtgggtctgctaacccgtacgtttccgtgggcaagtcgtgtgtactcctcgccatggctcagctccaaacacgcttctacactgataacaagaaatatgccgtagatgatgttcccttctcaatccctgctgcctctgaaattgccgaccttagtaacatcatcaataaactactaaaggacaaaaatgagttccacaaacatgtggagtttgatttccttattaagggccagtttctgcgaatgcccttggacaaacacatggaaatggagaacatctcatcagaagaagttgtggaaatagaatacgtggagaagtatactgcaccccagccagagcaatgcatgttccatgatgactggatcagttcaattaaaggggcagaggaatggatcttgactggttcttatgataagacttctcggatctggtccttggaaggaaagtcaataatgacaattgtgggacatacggatgttgtaaaagatgtggcctgggtgaaaaaagatagtttgtcctgcttattattgagtgcttctatggatcagactattctcttatgggagtggaatgtagagagaaacaaagtgaaagccctacactgctgtagaggtcatgctggaagtgtagattctatagctgttgatggctcaggaactaaattttgcagtggctcctgggataagatgctaaagatctggtctacagtccctacagatgaagaagatgaaatggaggagtccacaaatcgaccaagaaagaaacagaagacagaacagttgggactaacaaggactcccatagtgaccctctctggccacatggaggcagtttcctcagttctgtggtcagatgctgaagaaatctgcagtgcatcttgggaccatacaattagagtgtgggatgttgagtctggcagtcttaagtcaactttgacaggaaataaagtgtttaattgtatttcctattctccactttgtaaacgtttagcatctggaagcacagataggcatatcagactgtgggatccccgaactaaagatggttctttggtgtcgctgtccctaacgtcacatactggttgggtgacatcagtaaaatggtctcctacccatgaacagcagctgatttcaggatctttagataacattgttaagctgtgggatacaagaagttgtaaggctcctctctatgatctggctgctcatgaagacaaagttctgagtgtagactggacagacacagggctacttctgagtggaggagcagacaataaattgtattcctacagatattcacctaccacttcccatgttggggcatgaaagtgaacaataatttgactatagagattatttctgtaaatgaaattggtagagaaccatgaaattacatagatgcagatgcagaaagcagccttttgaagtttatataatgttttcacccttcataacagctaacgtatcactttttcttattttgtatttataataagataggttgtgtttataaaatacaaactgtggcatacattctctatacaaacttgaaattaaactgagttttacatttctctttaaaggtaaaagtt

SEQ ID NO: 437300 - DNA, 2115 bp, Homo sapiens
ctctaaaagccgcagttagaggcgagatttaggaaaaacctctgccgagtgagcctctggttgggaatatgtatgagaaaaaaaaactggcaaggcgttagtcaagcaaagctgaaggcagaggaaatttgatatctggctggagtctagaggatttaatgcaaataagatactctgagggcagcgtggcaaaaaaagactacaattcccggtggtcacagcgtttgagaagcgatgctttctgagacttgtagtaactaggagctgtgtttgaactatccaggctcaggacagcctcttgaaaaaaaattttttattaataaagcggatttgagtgggatctttttcctaatcgattacgggcccacacgtatgggaagaattctaacaatgattaaagggacatgctacctttacgactatccttttctaatcgatgactcctaaatctaggagtaggtagtcgatgtttgtggtctgggcgtctgtagaagggcaacctcgtgctttctgcagaggagaccggagggcagaaggcagagtccaggcttagactgcagttcctcgcttacctgtgcagtctaattttgagctgcctctttgtagtcttaaaaggcaggagcttcgtgttgtgggtctgctaacccgtacgtttccgtgggcaagtcgtgtgtactcctcgccatggctcagctccaaacacgcttctacactgataacaagaaatatgccgtagatgatgttcccttctcaatccctgctgcctctgaaattgccgaccttagtaacatcatcaataaactactaaaggacaaaaatgagttccacaaacatgtggagtttgatttccttattaagggccagtttctgcgaatgcccttggacaaacacatggaaatggagaacatctcatcagatcttgactggttcttatgataagacttctcggatctggtccttggaaggaaagtcaataatgacaattgtgggacatacggatgttgtaaaagatgtggcctgggtgaaaaaagatagtttgtcctgcttattattgagtgcttctatggatcagactattctcttatgggagtggaatgtagagagaaacaaagtgaaagccctacactgctgtagaggtcatgctggaagtgtagattctatagctgttgatggctcaggaactaaattttgcagtggctcctgggataagatgctaaagatctggtctacagtccctacagatgaagaagatgaaatggaggagtccacaaatcgaccaagaaagaaacagaagacagaacagttgggactaacaaggactcccatagtgaccctctctggccacatggaggcagtttcctcagttctgtggtcagatgctgaagaaatctgcagtgcatcttgggaccatacaattagagtgtgggatgttgagtctggcagtcttaagtcaactttgacaggaaataaagtgtttaattgtatttcctattctccactttgtaaacgtttagcatctggaagcacagataggcatatcagactgtgggatccccgaactaaagatggttctttggtgtcgctgtccctaacgtcacatactggttgggtgacatcagtaaaatggtctcctacccatgaacagcagctgatttcaggatctttagataacattgttaagctgtgggatacaagaagttgtaaggctcctctctatgatctggctgctcatgaagacaaagttctgagtgtagactggacagacacagggctacttctgagtggaggagcagacaataaattgtattcctacagatattcacctaccacttcccatgttggggcatgaaagtgaacaataatttgactatagagattatttctgtaaatgaaattggtagagaaccatgaaattacatagatgcagatgcagaaagcagccttttgaagtttatataatgttttcacccttcataacagctaacgtatcactttttcttattttgtatttataataagataggttgtgtttataaaatacaaactgtggcatacattctctatacaaacttgaaattaaactgagttttacatttctctttaaaggtaaaagtt

SEQ ID NO: 437301 - DNA, 1943 bp, Homo sapiens
ctctaaaagccgcagttagaggcgagatttaggaaaaacctctgccgagtgagcctctggttgggaatatgtatgagaaaaaaaaactggcaaggcgttagtcaagcaaagctgaaggcagaggaaatttgatatctggctggagtctagaggatttaatgcaaataagatactctgagggcagcgtggcaaaaaaagactacaattcccggtggtcacagcgtttgagaagcgatgctttctgagacttgtagtaactaggagctgtgtttgaactatccaggctcaggacagcctcttgaaaaaaaattttttattaataaagcggatttgagtgggatctttttcctaatcgattacgggcccacacgtatgggaagaattctaacaatgattaaagggacatgctacctttacgactatccttttctaatcgatgactcctaaatctaggagtaggtagtcgatgtttgtggtctgggcgtctgtagaagggcaacctcgtgctttctgcagaggagaccggagggcagaaggcagagtccaggcttagactgcagttcctcgcttacctgtgcagtctaattttgagctgcctctttgtagtcttaaaaggcaggagcttcgtgttgtgggtctgctaacccgtacgtttccgtgggcaagtcgtgtgtactcctcgccatggctcagctccaaacacgcttctacactgataacaagaaatatgccgtagatgatgttcccttctcaatccctgctgcctctgaaattgccgaccttagtaacatcatcaataaactactaaaggacaaaaatgagttccacaaacatgtggagtttgatttccttattaagggccagtttctgcgaatgcccttggacaaacacatggaaatggagaacatctcatcagaagaagttgtggaaatagaatacgtggagaagtatactgcaccccagccagagcaatgcatgttccatgatgactggatcagttcaattaaaggggcagaggaatggatcttgactggttcttatgataagacttctcggatctggtccttggaaggaaagtcaataatgacaattgtgggacatacggatgttgtaaaagatgtggcctgggtgaaaaaagatagtttgtcctgcttattattgagtgcttctatggatcagactattctcttatgggagtggaatgtagagagaaacaaagtgaaagccctacactgctgtagaggtcatgctggaagtgtagattctatagctgttgatggctcaggaactaaattttgcagtggctcctgggataagatgctaaagatctggtctacagtccctacagatgaagaagatgaaatggaggagtccacaaatcgaccaagaaagaaacagaagacagaacagttgggactaacaaggactcccatagtgaccctctctggccacatggaggcagtttcctcagttctgtggtcagatgctgaagaaatctgcagtgcatcttgggaccatacaattagagtgtgggatgttgagtctggcagtcttaagtcaactttgacaggaaataaagtgtttaattgtatttcctattctccactttgtaaacgtttagcatctggaagcacagataggcatatcagactgtgggatccccgaactaaagatggttctttggtgtcgctgtccctaacgtcacatactggttgggtgacatcagtaaaatggtctcctacccatgaacagcagctgatttcaggatctttagataacattgttaagctgtgggatacaagaaggtaaattctatttatgatctataagagaaacatatcaattacctgttatagaaaggaaatgaatactgaaattcttatctaaaaccagaagagtaaaaaaagcctcatggttttgcaacctcatgtgacaaatactga

SEQ ID NO: 437302 - DNA, 1651 bp, Homo sapiens
ctctaaaagccgcagttagaggcgagatttaggaaaaacctctgccgagtgagcctctggttgggaatatgtatgagaaaaaaaaactggcaaggcgttagtcaagcaaagctgaaggcagaggaaatttgatatctggctggagtctagaggatttaatgcaaataagatactctgagggcagcgtggcaaaaaaagactacaattcccggtggtcacagcgtttgagaagcgatgctttctgagacttgtagtaactaggagctgtgtttgaactatccaggctcaggacagcctcttgaaaaaaaattttttattaataaagcggatttgagtgggatctttttcctaatcgattacgggcccacacgtatgggaagaattctaacaatgattaaagggacatgctacctttacgactatccttttctaatcgatgactcctaaatctaggagtaggtagtcgatgtttgtggtctgggcgtctgtagaagggcaacctcgtgctttctgcagaggagaccggagggcagaaggcagagtccaggcttagactgcagttcctcgcttacctgtgcagtctaattttgagctgcctctttgtagtcttaaaaggcaggagcttcgtgttgtgggtctgctaacccgtacgtttccgtgggcaagtcgtgtgtactcctcgccatggctcagctccaaacacgcttctacactgataacaagaaatatgccgtagatgatgttcccttctcaatccctgctgcctctgaaattgccgaccttagtaacatcatcaataaactactaaaggacaaaaatgagttccacaaacatgtggagtttgatttccttattaagggccagtttctgcgaatgcccttggacaaacacatggaaatggagaacatctcatcagaagaagttgtggaaatagaatacgtggagaagtatactgcaccccagccagagcaatgcatgttccatgatgactggatcagttcaattaaaggggcagaggaatggatcttgactggttcttatgataagacttctcggatctggtccttggaaggaaagtcaataatgacaattgtgggacatacggatgttgtaaaagatgtggcctgggtgaaaaaagatagtttgtcctgcttattattgagtgcttctatggatcagactattctcttatgggagtggaatgtagagagaaacaaagtgaaagccctacactgctgtagaggtcatgctggaagtgtagattctatagctgttgatggctcaggaactaaagtaagtagctagaatattattagtactctgttaaatttgaatttgagcttgttgctaaacattttcttctgcatatattcattgtgttggcctagtttcctaacaatcggtgacaaaagataggatttcaaagcaagagtaaatactcatacaataggagatagtcacttgctcagtttgaatccctggtttagaaccttatataaactccagaaattttaagaaatgaggtatgggccgggcgcggtggctcacgcctgtaatcccagcactttgggaggccgaggcgggcagatcacctgaggtcaggagttcaagaccagcctgacccacatggagaaaccctgtctctactaaa

SEQ ID NO: 437303 - DNA, 539 bp, Homo sapiens
ttctctctcacttcagattggctttcttcaaaagacatggcaataagcttggccttcaagatttcccagattttatgttctgtcctatctgcccctggaaaaaggctaatttcagttctgtggaacacaagttctttgaaaaggtcctgaatgaggaagagacctactgttgtaggcaaataatatgaatcatattacatatgtcttttcccttcatatacatctgtttagttttgcagtggctcctgggataagatgctaaagatctggtctacaggtaaattaaatatttattttaccttgacttaataatgttgtttcaaaaatttaaattcggaggctatatggtggcttacgcctataatctcagcacttcaggaagccagggtagaaggatcacttgaggccacgagttcaagagcagcctaggccacatagtgagaccccgtctctactaaaagtagaaaattaaaattagcaaggtgtggtggtatgcaccggtagtcctagctccttgggaggctgaggtaaggggattg

SEQ ID NO: 437304 - DNA, 2265 bp, Homo sapiens
ctctaaaagccgcagttagaggcgagatttaggaaaaacctctgccgagtgagcctctggttgggaatatgtatgagaaaaaaaaactggcaaggcgttagtcaagcaaagctgaaggcagaggaaatttgatatctggctggagtctagaggatttaatgcaaataagatactctgagggcagcgtggcaaaaaaagactacaattcccggtggtcacagcgtttgagaagcgatgctttctgagacttgtagtaactaggagctgtgtttgaactatccaggctcaggacagcctcttgaaaaaaaattttttattaataaagcggatttgagtgggatctttttcctaatcgattacgggcccacacgtatgggaagaattctaacaatgattaaagggacatgctacctttacgactatccttttctaatcgatgactcctaaatctaggagtaggtagtcgatgtttgtggtctgggcgtctgtagaagggcaacctcgtgctttctgcagaggagaccggagggcagaaggcagagtccaggcttagactgcagttcctcgcttacctgtgcagtctaattttgagctgcctctttgtagtcttaaaaggcaggagcttcgtgttgtgggtctgctaacccgtacgtttccgtgggcaagtcgtgtgtactcctcgccatggctcagctccaaacacgcttctacactgataacaagaaatatgccgtagatgatgttcccttctcaatccctgctgcctctgaaattgccgaccttagtaacatcatcaataaactactaaaggacaaaaatgagttccacaaacatgtggagtttgatttccttattaagggccagtttctgcgaatgcccttggacaaacacatggaaatggagaacatctcatcagaagaagttgtggaaatagaatacgtggagaagtatactgcaccccagccagagcaatgcatgttccatgatgactggatcagttcaattaaaggggcagaggaatggatcttgactggttcttatgataagacttctcggatctggtccttggaaggaaagtcaataatgacaattgtgggacatacggatgttgtaaaagatgtggcctgggtgaaaaaagatagtttgtcctgcttattattgagtgcttctatggatcagactattctcttatgggagtggaatgtagagagaaacaaagtgaaagccctacactgctgtagaggtcatgctggaagtgtagattctatagctgttgatggctcaggaactaaattttgcagtggctcctgggataagatgctaaagatctggtctacagtccctacagatgaagaagatgaaatggaggagtccacaaatcgaccaagaaagaaacagaagacagaacagttgggactaacaaggactcccatagtgaccctctctggccacatggaggcagtttcctcagttctgtggtcagatgctgaagaaatctgcagtgcatcttgggaccatacaattagagtgtgggatgttgagtctggcagtcttaagtcaactttgacaggaaataaagtgtttaattgtatttcctattctccactttgtaaacgtttagcatctggaagcacagataggcatatcagactgtgggatccccgaactaaagatggttctttggtgtcgctgtccctaacgtcacatactggttgggtgacatcagtaaaatggtctcctacccatgaacagcagctgatttcaggatctttagataacattgttaagctgtgggatacaagaagttgtaaggctcctctctatgatctggctgctcatgaagacaaagttctgagtgtagactggacagacacagggctacttctgagtggaggagcccgacccaaaattggttttctacctgatattcacctaccactttccaggtgggggactgacacgggcactctaactttgactattagcgcatcctttccgcaagctcaatccggctacagacacctgtacgttccttgtacgtccatgcccaaagcacccttccgcatgtactctctgtcgctcacccctcctacagctacgattcactttcctctctcggattctccacacccagctcgccacactccaccggcggaccatccccccacccaccaccagggttacgttcaccacaaccaaaggcccgacaccaccgccatctccactccctacgccccccagctcacgccgcgccctagctgctcg

SEQ ID NO: 437305 - DNA, 1932 bp, Homo sapiens
gaggatttacccagccgttgggcggcagctgttcaatggtcgcgtaggctggggatgggcggggtgacctgaagccccgccccagcatacctgcgcagccgcagtcgacaggctctggctgcccatcccttggcgggcgccggccgcggcactgaaacgagccttccctcagctggacatggaggagggctgacgtgctgacgtctacgcccgccccgcttttcgctgatggcgtcatttcctttcagctcagctgcagctggtgatctcctcatactgggcacggacctcggcaaggatgccatttaaatcgagggagtggctgttgtccatggacaggaccagggatgtgaccaagaactgggactacagctcacagatctcctcttcatacagctgaatgaggaagttgatcttgtcagtcagctcttccagatatgccgtagatgatgttcccttctcaatccctgctgcctctgaaattgccgaccttagtaacatcatcaataaactactaaaggacaaaaatgagttccacaaacatgtggagtttgatttccttattaagggccagtttctgcgaatgcccttggacaaacacatggaaatggagaacatctcatcagaagaagttgtggaaatagaatacgtggagaagtatactgcaccccagccagagcaatgcatgttccatgatgactggatcagttcaattaaaggggcagaggaatggatcttgactggttcttatgataagacttctcggatctggtccttggaaggaaagtcaataatgacaattgtgggacatacggatgttgtaaaagatgtggcctgggtgaaaaaagatagtttgtcctgcttattattgagtgcttctatggatcagactattctcttatgggagtggaatgtagagagaaacaaagtgaaagccctacactgctgtagaggtcatgctggaagtgtagattctatagctgttgatggctcaggaactaaattttgcagtggctcctgggataagatgctaaagatctggtctacagtccctacagatgaagaagatgaaatggaggagtccacaaatcgaccaagaaagaaacagaagacagaacagttgggactaacaaggactcccatagtgaccctctctggccacatggaggcagtttcctcagttctgtggtcagatgctgaagaaatctgcagtgcatcttgggaccatacaattagagtgtgggatgttgagtctggcagtcttaagtcaactttgacaggaaataaagtgtttaattgtatttcctattctccactttgtaaacgtttagcatctggaagcacagataggcatatcagactgtgggatccccgaactaaagatggttctttggtgtcgctgtccctaacgtcacatactggttgggtgacatcagtaaaatggtctcctacccatgaacagcagctgatttcaggatctttagataacattgttaagctgtgggatacaagaagttgtaaggctcctctctatgatctggctgctcatgaagacaaagttctgagtgtagactggacagacacagggctacttctgagtggaggagcagacaataaattgtattcctacagatattcacctaccacttcccatgttggggcatgaaagtgaacaataatttgactatagagattatttctgtaaatgaaattggtagagaaccatgaaattacatagatgcagatgcagaaagcagccttttgaagtttatataatgttttcacccttcataacagctaacgtatcactttttcttattttgtatttataataagataggttgtgtttataaaatacaaactgtggcatacattctctatacaaacttgaaattaaactgagttttacatttctctttaaaggtaaaagtt

SEQ ID NO: 437306 - DNA, 1068 bp, Homo sapiens
ccctggaaaaaggctaatttcagttctgtggaacacaagttctttgaaaaggtcctgaatgaggaagagacctactgttgtaggcaaataatatgaatcatattacatatgtcttttcccttcatatacatctgtttagttttgcagtggctcctgggataagatgctaaagatctggtctacagtccctacagatgaagaagatgaaatggaggagtccacaaatcgaccaagaaagaaacagaagacagaacagttgggactaacaaggactcccatagtgaccctctctggccacatggaggcagtttcctcagttctgtggtcagatgctgaagaaatctgcagtgcatcttgggaccatacaattagagtgtgggatgttgagtctggcagtcttaagtcaactttgacaggaaataaagtgtttaattgtatttcctattctccactttgtaaacgtttagcatctggaagcacagataggcatatcagactgtgggatccccgaactaaagatggttctttggtgtcgctgtccctaacgtcacatactggttgggtgacatcagtaaaatggtctcctacccatgaacagcagctgatttcaggatctttagataacattgttaagctgtgggatacaagaagttgtaaggctcctctctatgatctggctgctcatgaagacaaagttctgagtgtagactggacagacacagggctacttctgagtggaggagcagacaataaattgtattcctacagatattcacctaccacttcccatgttggggcatgaaagtgaacaataatttgactatagagattatttctgtaaatgaaattggtagagaaccatgaaattacatagatgcagatgcagaaagcagccttttgaagtttatataatgttttcacccttcataacagctaacgtatcactttttcttattttgtatttataataagataggttgtgtttataaaatacaaactgtggcatacattctctatacaaacttgaaattaaactgagttttacatttctctttaaaggtaaaagtt

SEQ ID NO: 437307 - DNA, 1018 bp, Homo sapiens
gcaggcaacactcccagcagctagagaatgaatgcctcagtctagaatggagatctgcatggtaaacgcagcttctactataatctgcataatatttgatgagatcagcctgggagagctaataggttgtccaaatagacgattggtttaaagttgacagtactttttcaaaattatattcatgattaagtttaggctttgcattctgactgacctgaatcatttgtgtttcatctctgtgtactacttgtgtaactttaatactgctaaacttctaagcctcaatttttatacagtgtagataacctacctcctagggttattgtgatgattaataagcagttatctttcggtgttttttttttttttgtcttaaattttagttggtttcaatacaagtagtaatttttatttccactcaggaattaaaaaaacttacacatattctaagttggaagaatagctttcactttgcgggatacaggaactcacatgcatcttctgatcagtggcactgattctaagcctgtctccaggacactcttgattttgaattcagtaaatatccagtgagcccatctaaggagtgttgcagcactggtctgagcaatcagcaaaccatggcctaagggccaaatctagtctgctgcctttgtacagcccagaagccagtaatggtttttacacctttaaagggttgtttaaaagcaaaacaaaataacagtaacacgtgacacaaacaggatgtagtttacagtctggctctttataaaaaagtttgatgaccctagcctagacctggaggcataaaagtaaacagttaaaacaaataggagtatgcattacaaagaaatgcctgagctagagaagcaacaaagtgacctcactttacatgtttagggtggtcagaggccatctcagagagtggcatttaaagctgagacctggcaggtgaggagctagccatgtgagtggctgcaaggctgatgtaatcagagtgaggaatgtagggaaaatg

SEQ ID NO: 437308 - DNA, 1231 bp, Homo sapiens
ggtccggaaaaggggggtaagatgcctatcctagtccctctcttcgggctcttcatctcaagaggaacaaacaagagcaaactcagtgttgagaggccccaaaccggactctcccacagagaggtgctcggtcccaagccccggaggcccgggaaggccgcctccggaggagcccccgcagacgccatactaaaagccaaaatggctgccccggaggaggcccgcaccgcgtagccagtgaaggttggggagcaagcttatgcgggaaagagggagggggactccaggaaaagccgttgagaggaccatcacaacctgagcagcacaggttccagttacagccatcccttgtcataacttttgaactgtatttggaaaaatactggccaggaaagaaaaatgataaaatttttcctcatggtgaataaacaagggcagactcgactttctaagtactatgaacatgtggatattaataagcgtacacttctggaaacagaagtcataaagagctgtctctctcgatccaatgaacaatgctctttcattgaatataaggattttaagctgatatatcggcagtatgcagctctcttcattgtggttggagttaatgacactgagaacgagatggctatttatgaattcattcataactttgtggaagttttagatgagtatttcagccgagtgagtgaattagatataatgtttaatttggataaagtacacatcattttggatgagatggtgttaaatggctgcattgtggaaactaacagggcaagaattcttgcccctctactaattcttgataagatgtcagaaagctgaaaggaagtctcttcgagacaatatggatttatcagaaatgcgagtaccgtggaatacatctcaacatgttaacccagaagaatctggaagaccacaattacaaaatggggtatccttccaaagacattataaataggcattttccacagttcctaaaaagaaaacacaactgtactttaaaatatgtacaaagaaaaaaatttctttaaactgagagagaagttttattttctaattgtaaacatatctgtcgcactttaaattctgttgagcacctaaggaacccttcttggtctatgcttcttttgcaaattgaattcaggaatagcaggatggtagtgggaagaaagtatggcagttttccgtcagccaataaagttttaaaatttaaacacaa

SEQ ID NO: 437309 - DNA, 646 bp, Homo sapiens
ggcctataattccagcactttgggaggccaagctggtcctgaactcctggccccaagccatcctctcaccttggcctcccaaagtgctaggattacggatatgaaccagcacatctggccaaaaaaaatcctagaagttaaggtttatctacatttcccccattgataaacatcttttaaacaagtgagtgatagaactgttctgaatatttgtcagtgggaggctactttcctcacattatcggttcactaagccacatgctctaaaacctgggacactgactggggaagttctatgtctgggtttacatggggaagcgacactaaaattgattgtaccctttccttccttttattgtagaacgagatggctatttatgaattcattcataactttgtggaagttttagatgagtatttcagccgagtgagtgaattgtctaatggctaaaaaatggtttacttcctcaacccagtttcccagaaattgagtctctttggatctatatcaagaacatgtgttaatacagagttttaataagtaaaagttaaaacttaagtgatgccaaattttctttatctttccttctggtttatccaaagtgttacaagcctatacatgcctgagatctttataaagaactgg

SEQ ID NO: 437310 - DNA, 1097 bp, Homo sapiens
taaatctcttcagtcgtttcataaatacagcatcgatcgtctggtttggtttttttatagataaagaaacggatgggggaaaggagatctagtggagagtactgtaaaaagaaaaattcagtgctgaaagcgttgatgagtcactaagtaaggaataactacagagaatccaagtgagtaaggcagcatctcaggttccagttacagccatcccttgtcataacttttgaactgtatttggaaaaatactggccaggaaagaaaaatgataaaatttttcctcatggtgaataaacaagggcagactcgactttctaagtactatgaacatgtggatattaataagcgtacacttctggaaacagaagtcataaagagctgtctctctcgatccaatgaacaatgctctttcattgaatataaggattttaagctgatatatcggcagtatgcagctctcttcattgtggttggagttaatgacactgagaacgagatggctatttatgaattcattcataactttgtggaagttttagatgagtatttcagccgagtgagtgaattagatataatgtttaatttggataaagtacacatcattttggatgagatggtgttaaatggctgcattgtggaaactaacagggcaagaattcttgcccctctactaattcttgataagatgtcagaaagctgaaaggaagtctcttcgagacaatatggatttatcagaaatgcgagtaccgtggaatacatctcaacatgttaacccagaagaatctggaagaccacaattacaaaatggggtatccttccaaagacattataaataggcattttccacagttcctaaaaagaaaacacaactgtactttaaaatatgtacaaagaaaaaaatttctttaaactgagagagaagttttattttctaattgtaaacatatctgtcgcactttaaattctgttgagcacctaaggaacccttcttggtctatgcttcttttgcaaattgaattcaggaatagcaggatggtagtgggaagaaagtatggcagttttccgtcagccaataaagttttaaaatttaaacacaa

SEQ ID NO: 437311 - DNA, 492 bp, Homo sapiens
ccaactacttgggaggctgtggtaggaggatcacttgaacccaggagacagaggttgcagtgagttgagatcgagattgtgccactgcactccagcctgggcacagagtgagattccgtctcaaaaaaaaaaaaaaaaaaaaaagtagaaagcaagaaagtgtctctgtacaggtaggcatgaaatgaatccttctcttcctcccctttactcctttaaccccttctcctgcaatgtcttgaagtaaattactgtcattacagaagagcaatgcactgcatccccccaaaacctttctatatgcttttgctaccccgttaacagaagaatatacagaactgtcttaggcgaaagtatgtacagtagtccctctcttatccactgtttcgcattctgtggtttgtgttactcatggtcaactgaggtcccaaaatattaaacagaaaattccagaaataaacaatgtataagttttaaactgcatgccattct

SEQ ID NO: 437312 - DNA, 849 bp, Homo sapiens
tgagaccctgtctctaaaaataagtaaataactaattaaaaagttagccagctgtggtggtgagcacctgtactcctaactactcaagaggctgagatgggagaattgatcaagcctaggagtttgaggctgcagtgaactatgatcacaacactgtactccaacctgggtaatggagtgaggccctgcctcaaaaacacaaaaacaaaacaaaaaaacttttataacatgtacctaacaaagatgcagagttaaattttatttgccagtttgtaaaagcctttgatactcattttaagggcacttagtaattacaatgccattatgtaattaactctatagagaacattactttcaaataatggatggtcagacattaagacagccccagagagcccctacagctatcctttatcccgttttttgtttgttttttggagacagcattccagcctgggcacagagtgagattccgtctcaaaaaaaaaaaaaaaaaaaaaagtagaaagcaagaaagtgtctctgtacaggtaggcatgaaatgaatccttctcttcctcccctttactcctttaaccccttctcctgcaatgtcttgaagtaaattactgtcattacagaagagcaatgcactgcatccccccaaaacctttctatatgcttttgctaccccgttaacagaagaatatacagaactgtcttaggcgaaagtatgtacagtagtccctctcttatccactgtttcgcattctgtggtttgtgttactcatggtcaactgaggtcccaaaatattaaacagaaaattccagaaataaacaatgtataagttttaaactgcatgccattct

SEQ ID NO: 437313 - DNA, 788 bp, Homo sapiens
tgagaccctgtctctaaaaataagtaaataactaattaaaaagttagccagctgtggtggtgagcacctgtactcctaactactcaagaggctgagatgggagaattgatcaagcctaggagtttgaggctgcagtgaactatgatcacaacactgtactccaacctgggtaatggagtgaggccctgcctcaaaaacacaaaaacaaaacaaaaaaacttttataacatgtacctaacaaagatgcagagttaaattttatttgccagtttgtaaaagcctttgatactcattttaagggcacttagtaattacaatgccattatgtaattaactctatagagaacattactttcaaataatggatggtcagacattaagacagccccagagagcccctacagctatcctttatcccgttttttgtttgttttttggagacagcatctccgtctcctaggctggagtgcagtggtgtgatcatgcctcactacagcctgtacctcctgggctcaggtgctcctcccacctcagcctcctgagtaactgggaccacaggtgcgcaccccctccacccagctaatttttgtattttgttgtagagatagggtttcactatgttgcccagactggtctcgaattcctgcagtcacatgatccatctgccttcgccttccaaagtgttgggattacaggcctgagccactgtgcccagtctttttatgccacattttaaaaggtttgcttattaataagcttactgttaatgaaatttagttcaaagttta

SEQ ID NO: 437314 - DNA, 1578 bp, Homo sapiens
gccgcagctaccggacacctgggctccgactctgacttttggaagcgaggcggccttaggcttcctggttatcagtttccttttagcaggccgtccccgggcgctgtttccttcccaggggtctctcacccgtgtcccggctttctgagctggttgttaacctggctggtcgctctggccgaccgcatcccgtctcggattcctgacgtttctttttcattctttgagtgtttcaggcagtcccaagggtgggccctctttcccttcctgtcactcgctctgcctctggtttcttagaaccagtcagttctctgctggcaaatagccaagatcctccggctgtggttactgattcctcgtctccgtcttgagcctgggctttggtcccatttctatgcgctcggtcgcccgtcgtaacttattccactttgcgtcccctcttctttccttttctggaatgggttgtgggggggttgggagagggggaggagcgattttttttttcttgggagaagaagaggtagtgaattcctttagatcttgacgatgatgggtagagggagagaagtttgaaggagactggctagactaacaatttgatacggtagaaatgaatgggctcacaaatattgtcatcaatagactattttgatcgaaacagaaaataaaagcactgttccagttacagccatcccttgtcataacttttgaactgtatttggaaaaatactggccaggaaagaaaaatgataaaatttttcctcatggtgaataaacaagggcagactcgactttctaagtactatgaacatgtggatattaataagcgtacacttctggaaacagaagtcataaagagctgtctctctcgatccaatgaacaatgctctttcattgaatataaggattttaagctgatatatcggcagtatgcagctctcttcattgtggttggagttaatgacactgagaacgagatggctatttatgaattcattcataactttgtggaagttttagatgagtatttcagccgagtgagtgaattagatataatgtttaatttggataaagtacacatcattttggatgagatggtgttaaatggctgcattgtggaaactaacagggcaagaattcttgcccctctactaattcttgataagatgtcagaaagctgaaaggaagtctcttcgagacaatatggatttatcagaaatgcgagtaccgtggaatacatctcaacatgttaacccagaagaatctggaagaccacaattacaaaatggggtatccttccaaagacattataaataggcattttccacagttcctaaaaagaaaacacaactgtactttaaaatatgtacaaagaaaaaaatttctttaaactgagagagaagttttattttctaattgtaaacatatctgtcgcactttaaattctgttgagcacctaaggaacccttcttggtctatgcttcttttgcaaattgaattcaggaatagcaggatggtagtgggaagaaagtatggcagttttccgtcagccaataaagttttaaaatttaaacacaa

SEQ ID NO: 437315 - DNA, 968 bp, Homo sapiens
ggcctataattccagcactttgggaggccaagctggtcctgaactcctggccccaagccatcctctcaccttggcctcccaaagtgctaggattacggatatgaaccagcacatctggccaaaaaaaatcctagaagttaaggtttatctacatttcccccattgataaacatcttttaaacaagtgagtgatagaactgttctgaatatttgtcagtgggaggctactttcctcacattatcggttcactaagccacatgctctaaaacctgggacactgactggggaagttctatgtctgggtttacatggggaagcgacactaaaattgattgtaccctttccttccttttattgtagaacgagatggctatttatgaattcattcataactttgtggaagttttagatgagtatttcagccgagtgagtgaattagatataatgtttaatttggataaagtacacatcattttggatgagatggtgttaaatggctgcattgtggaaactaacagggcaagaattcttgcccctctactaattcttgataagatgtcagaaagctgaaaggaagtctcttcgagacaatatggatttatcagaaatgcgagtaccgtggaatacatctcaacatgttaacccagaagaatctggaagaccacaattacaaaatggggtatccttccaaagacattataaataggcattttccacagttcctaaaaagaaaacacaactgtactttaaaatatgtacaaagaaaaaaatttctttaaactgagagagaagttttattttctaattgtaaacatatctgtcgcactttaaattctgttgagcacctaaggaacccttcttggtctatgcttcttttgcaaattgaattcaggaatagcaggatggtagtgggaagaaagtatggcagttttccgtcagccaataaagttttaaaatttaaacacaa

SEQ ID NO: 437316 - DNA, 1806 bp, Homo sapiens
  misc_feature (1569)..(1569): n is a, c, g, or t
  misc_feature (1597)..(1597): n is a, c, g, or t
ggtccggaaaaggggggtaagatgcctatcctagtccctctcttcgggctcttcatctcaagaggaacaaacaagagcaaactcagtgttgagaggccccaaaccggactctcccacagagaggtgctcggtcccaagccccggaggcccgggaaggccgcctccggaggagcccccgcagacgccatactaaaagccaaaatggctgccccggaggaggcccgcaccgcgtagccagtgaaggttggggagcaagcttatgcgggaaagagggagggggactccaggaaaagccgttgagaggaccatcacaacctgagcagcacaggttccagttacagccatcccttgtcataacttttgaactgtatttggaaaaatactggccaggaaagaaaaatgataaaatttttcctcatggtgaataaacaagggcagactcgactttctaagtactatgaacatgtggatattaataagcgtacacttctggaaacagaagtcataaagagctgtctctctcgatccaatgaacaatgctctttcattgaatataaggattttaagctgatatatcggcagtatgcagctctcttcattgtggttggagttaatgacactgagaacgagatggctatttatgaattcattcataactttgtggaagttttagatgagtatttcagccgagtgagtgaattagtgaattagatgtatcctttttcaatactgttttccacagtacttggcaaatgcactctggtccttatcaggaaccaattgatgaacttcccaaaatatgctcagccctggagccccagcagacttgcttttctccagacagttcatcattcaaaggagctgcctccaccacccccatctactgaatagccaggggagggcaccaatgaacagcacagtatgggagacacaccaactactcttcaaatcagtgcgtacctgctctacgcgtgaaggtacagaaaacctccacggccttttcagtatttggtgcctttaaagaggcctaaggacttagtttatttgggctagactggaatgcagcagtactgccttcaggcctggacagccaggggctcctcgggccctgtgctctagaaggcccattctatgtctgcttcgccagcaccctttccccatcatggggcagatgcccaccagccctcactatctactgcttgaccatcctctgacttcctgggcccctagaatttataaggtccctagatatcccagaacctgccaccatggcctctgcaagcctctcctccaccttcaccccaagactaggggcaggaatgataagaaggctgggtggtagctgggatgtcccacctacgtgcctggggagagaagcaagagcaggctggagtctctactttgtattcttgtgaggcacaaatataggctagaatccaggccccacaaatataggctagaatccggaatgttttcttgatttaaagacatctttagaccgggcacagtggctcacgccagtaatcccagcactttggagggctgaagcaggaggattgcttgaggccnggagtttgagaccagcctgggcaacatngggagacccagtctctacaaaaaaatttaaaaagccaggcattggtggtgtgtgcctatagtcccaactactagggaggctgaggtgggaggatcacttgagcctgggggactgaggctgcagtgagccatgattgtgctactgcactccaatctggcaacagagcgagaccttgtctttaaaaataaaaataaaaacatctttacaac

SEQ ID NO: 437317 - DNA, 649 bp, Homo sapiens
ggtccggaaaaggggggtaagatgcctatcctagtccctctcttcgggctcttcatctcaagaggaacaaacaagagcaaactcagtgttgagaggccccaaaccggactctcccacagagaggtgctcggtcccaagccccggaggcccgggaaggccgcctccggaggagcccccgcagacgccatactaaaagccaaaatggctgccccggaggaggcccgcaccgcgtagccagtgaaggttggggagcaagcttatgcgggaaagagggagggggactccaggaaaagccgttgagaggaccatcacaacctgagcagcacaggttccagttacagccatcccttgtcataacttttgaactgtatttggaaaaatactggccaggaaagaaaaatgataaaatttttcctcatggtgaataaacaagggcagactcgactttctaagtaatatgcttttgctaccccgttaacagaagaatatacagaactgtcttaggcgaaagtatgtacagtagtccctctcttatccactgtttcgcattctgtggtttgtgttactcatggtcaactgaggtcccaaaatattaaacagaaaattccagaaataaacaatgtataagttttaaactgcatgccattct

SEQ ID NO: 437318 - DNA, 909 bp, Homo sapiens
ggtccggaaaaggggggtaagatgcctatcctagtccctctcttcgggctcttcatctcaagaggaacaaacaagagcaaactcagtgttgagaggccccaaaccggactctcccacagagaggtgctcggtcccaagccccggaggcccgggaaggccgcctccggaggagcccccgcagacgccatactaaaagccaaaatggctgccccggaggaggcccgcaccgcgtagccagtgaaggttggggagcaagcttatgcgggaaagagggagggggactccaggaaaagccgttgagaggaccatcacaacctgagcagcacaggttccagttacagccatcccttgtcataacttttgaactgtatttggaaaaatactggccaggaaagaaaaatgataaaatttttcctcatggtgaataaacaagggcagactcgactttctaagtactatgaacatgtggatattaataagcgtacacttctggaaacagaagtcataaagagctgtctctctcgatccaatgaacaatgctctttcattgaatataaggattttaagctgatatatcggcagtatgcagctctcttcattgtggttggagttaatgacactgagaacgagatggctatttatgaattcattcataactttgtggaagttttagatgagtatttcagccgagtgagtgaattgtctaatggctaaaaaatggtttacttcctcaacccagtttcccagaaattgagtctctttggatctatatcaagaacatgtgttaatacagagttttaataagtaaaagttaaaacttaagtgatgccaaattttctttatctttccttctggtttatccaaagtgttacaagcctatacatgcctgagatctttataaagaactgg

SEQ ID NO: 437319 - DNA, 1041 bp, Homo sapiens
cgccccgctccgcccctatcgcggcgccccgagatcacccgcctccggcgcctggctccctgcaggcgaggagcggaagccgctatctggaggcggactccggcgccacagagccggggcagccgcggcaacggcgaggcgcgaggcaggggcgcccggcagaccccgagaccccgagccagcgggcgccccgagcgggcagcctcgccgggggaggcggaggcggcacggcggccgcgctcgggcgcccctcgcgcagcgctccatgcccgtgtggtgctgccgctgctccctggccggtcatttcagaaactatagtgacactgaaactgaaggagagatttttaattccttagtgcaatactttggtgacaacttggggcgaaaagttaaagcgatgccattagttgaagaaacttctttactggaagattcgtcagtgacttttcctgtggtaataataggaaatggaccctcaggaatatgcctttcttatatgttatcaggctacagaccgtatttatcatcagaagcaatacacccaaatacaatcttaaatagtaaattagaagaagcaagacatctttccattgttgatcaggacttagaatacttgtctgagggccttgagggccgatcatccaatccagttgcagtacttttcgatacacttcttcatccagatgctgactttgggtatgattatccatccgttttgcattggaaattagagcaacatcattatatccctcacgtagttcttggtaaaggtccacctggtggggcttggcataatatggaaggctccatgttgacaatcagctttggaagttggatggaactacctggacttaaatttaaggactgggtatcaagtaaacgaaggtaaagattgaactgtattaaaattctttggtgtacgttgaaaaagagaatgtggaaaaatttcaaaatatttgtgattttgtcatggctgaagaatataaatgtacgtctttcaaataaaaatgtgtccttgaagcagtgattataaaaaactag

SEQ ID NO: 437320 - DNA, 4394 bp, Homo sapiens
gagtacttttctaactccctattgcatcacaaacgcccgcaggggcttaaaaagcagcaggggttcctgcccttccccacactggccggtgtggtctggggcgggcctgatgagcacctggattttcacccggcgtgctggtaattcctacacttgtgggtgtttgagagacatgaagaggggaggatgacctcttcccggaagcgggacttccataaaagaagcgtggtgggcgggtcccgggcacctgtggtttggtgagtcctccaggtaactgtgatgcgggggtcagcgggagaggcacccggaagctcccggcgtctgcaccccggcagcgcgaggaaatgcccaaagaaactatagtgacactgaaactgaaggagagatttttaattccttagtgcaatactttggtgacaacttggggcgaaaagttaaagcgatgccattagttgaagaaacttctttactggaagattcgtcagtgacttttcctgtggtaataataggaaatggaccctcaggaatatgcctttcttatatgttatcaggctacagaccgtatttatcatcagaagcaatacacccaaatacaatcttaaatagtaaattagaagaagcaagacatctttccattgttgatcaggacttagaatacttgtctgagggccttgagggccgatcatccaatccagttgcagtacttttcgatacacttcttcatccagatgctgactttgggtatgattatccatccgttttgcattggaaattagagcaacatcattatatccctcacgtagttcttggtaaaggtccacctggtggggcttggcataatatggaaggctccatgttgacaatcagctttggaagttggatggaactacctggacttaaatttaaggactgggtatcaagtaaacgaaggagcctaaaaggggatcgagttatgccagaggaaatagctcgctactataaacattatgtaaaagtcatgggtcttcagaagaatttcagagagaatacttacataacttccgtatcaagactctacagagatcaagatgatgatgatattcaagacagagatatttcaacaaagcatttacagatagagaagtcaaactttatcaagagaaactgggaaattaggggttatcagcgaatagctgatggttctcatgttcccttctgcctctttgctgagaatgtagcgctggcaactggaacgctggattctcctgcccatctggaaattgaaggggaagattttccttttgtgtttcattcaatgcctgaatttggagctgctataaacaaaggaaagttgcgtggcaaagtggatccagtgttaattgtaggttctgggcttactgccgctgacgcagtactgtgtgcttacaacagtaatatccctgtgattcatgtgtttcgcagacgagtaactgatccaagcttaattttcaaacagcttcccaaaaagctgtatcctgaatatcataaagtctatcatatgatgtgtactcagtcatattctgtagactcaaatcttttatctgattataccagctttcccgagcaccgtgtgctttcctttaagtcggacatgaaatgtgttctccaaagcgtttctggattgaagaaaatatttaagctgtctgcagcagtagtattgataggttctcatcctaatctgtcttttctgaaggatcaagggtgttacctaggccataagtcaagccagccaatcacatgtaagggtaatcctgtggaaatagatacatatacctatgagtgtattaaagaagccaacctttttgcattgggtcctttggttggagacaattttgttcgatttttaaagggaggggcgctgggtgttacacgctgtttagctacaagacagaagaaaaagcatttgtttgttgaaagaggaggaggagatgggatagcttaaagcaagtttacaagtaattaaaatggacagtttgccattaaagatttttaatagtggttttgcagtgtactggcttgaattttctggacttgagttaactgaaggagagcctcaaactatagtaacttcatttttaaaagttactagaatttggtatcctgatttatattgcagtgtttcaaaggtgtcactgtcagacaaatagaaacactgccaacttggtgtaacttaagctttcatttaactaaaacattcttttcttgcaaaacttatttttcatgatcatttttggttatttattatacttgattccaaaatagtacagccttgaatctataaaactgtgcagtcattatgccagaaattatcttaaatatataatgggtcaccttgctgttcaaagggtggtgcaaggtcctgcagcatcttacatctgtagcttgttagaaatgtaaactctcaggccccacaacttacttcctgcattttaacaagatccccaagggatatgtatgctcataaaaatttgagacactggtttaaatgaaaatggatataaggtatgtataactgggggtggggtgagggtaggaggcatttacaactcagattttatttattttgaaattatcaattgtataaatctaatttattaccaaatagggtcttttaaaaaatatttttatcgttgaaaccttgacaggtacttcatattcttctaataatttaaacagtccaataatgtggtatacactttgacatccaagaactcaccaagatgtttttcagagatttattctcgatttaactatcatagcatttaatgaatctgatttgtagttcaataaattgtgggttgaactacttatccctgtgtgaacattgaattactttctgtcactgaaactgaggtatttgggtgtggtaagtacttcgaaaattgtaatactgtttgggcattgtctaaattattaaaggttaaaatagaaaataaagtcagaatttttcttttccattccaaaggtgtacttagagatctctattagtattcattcgagatgacatagcagctcatatcatggttgtttattggatttatctgttctaattatataagtgtgtttactgtctgtgttttcacacaaactgctagaatttttaatgttaagacgaaaacatctgaagttctccatggcaaattgaatttttcagtcattttcttttctttttttggtacaattacttcatctggaatgtcttcattgaactcgttattctatttttcttagaattaaaagtggattaatgtgggtttttctgttcattttattgcagtattaaatgcttaagcttattaggaccataattcactttaaatataattgtatagaatatatttgcgtcgatcaaataattgcttcagatgaattcttagactcttgataatatcacacctaatttaacttgattttacaagctgtacaatccagttttagttttctattgtgataataacttttttcaaaccagtttcacatcttaatgaaataacattctctgactgcacttgcttcagtactctcttgcctgcctgtttttgacctctgcatgagttggattagatgtttttcttactgtcacttctaaatagaaaatgacagtgttataaaaaagggaaggataaaacctttgacatccccttgtgtctcaaaagtccacagttattcaaacaatggctttttttgtgatgagagtatttgttaaaaaaaaaaaaagacttcaagaaaaataaaagttcagtggagctgcaaataaatctggtgaataatttcatctttggtaatctcccatttcctgagttcttcctcaatccaagctgtcctgtgtagtatataacatttgggcattttctctgatatactatactctcatgttctataaatttctgtcccgtaattctaacactttacattttttctttgctatcagctatagctattcatggaagggaagaatcactaaatacttgtctagttatagcatgatgtgagcatctcctccttatccctcgatgcctggcttggtgtctggcaaacagtccataattagcagatgttgaaagaccgtttacaaagcagaatttggggatttaaagtgcaatgatacaacaaaaagatttaattacagcttccagtgttttgactatgtgaaccatatccaactacttttttgaaaatctagttctatgtaatatatttctgtggcatcaaattttagttgattgtattagtcaataggaagtggtggaaaatttctaaataaattcaactattaaataaatgcaagttccactaaatcttagtgtttggaacactgaagaacccagaatgaaacaaaattagactgaatgtaaatgtcatttaaaaatctaact

SEQ ID NO: 437321 - DNA, 450 bp, Homo sapiens
gagtacttttctaactccctattgcatcacaaacgcccgcaggggcttaaaaagcagcaggggttcctgcccttccccacactggccggtgtggtctggggcgggcctgatgagcacctggattttcacccggcgtgctggtaattcctacacttgtgggtgtttgagagacatgaagaggggaggatgacctcttcccggaagcgggacccaaaggtgggttctcaggcgtgggaagctcgacccttcccggggtcctcggcgaagtggccgaggccgcgccttacgcagggaactccgccgggccatctgggtggcccgagttcgcagcagcttctcttccgctcgtccctcggccctctcgacgcgcacccaccggcctcaccaagtcgcacgcagaggggcggcggggcgctgaccgaggtctaggtctcgattgccgccggtcga

SEQ ID NO: 437322 - DNA, 4065 bp, Homo sapiens
cgacgattgtaaatacgactggccgagtgccagagctttgcatgacctgacaggtgcgactcatagatggatcacactagattgaacagacattggggcgaaaagttaaagcgatgccattagttgaagaaacttctttactggaagattcgtcagtgacttttcctgtggtaataataggaaatggaccctcaggaatatgcctttcttatatgttatcaggctacagaccgtatttatcatcagaagcaatacacccaaatacaatcttaaatagtaaattagaagaagcaagacatctttccattgttgatcaggacttagaatacttgtctgagggccttgagggccgatcatccaatccagttgcagtacttttcgatacacttcttcatccagatgctgactttgggtatgattatccatccgttttgcattggaaattagagcaacatcattatatccctcacgtagttcttggtaaaggtccacctggtggggcttggcataatatggaaggctccatgttgacaatcagctttggaagttggatggaactacctggacttaaatttaaggactgggtatcaagtaaacgaaggagcctaaaaggggatcgagttatgccagaggaaatagctcgctactataaacattatgtaaaagtcatgggtcttcagaagaatttcagagagaatacttacataacttccgtatcaagactctacagagatcaagatgatgatgatattcaagacagagatatttcaacaaagcatttacagatagagaagtcaaactttatcaagagaaactgggaaattaggggttatcagcgaatagctgatggttctcatgttcccttctgcctctttgctgagaatgtagcgctggcaactggaacgctggattctcctgcccatctggaaattgaaggggaagattttccttttgtgtttcattcaatgcctgaatttggagctgctataaacaaaggaaagttgcgtggcaaagtggatccagtgttaattgtaggttctgggcttactgccgctgacgcagtactgtgtgcttacaacagtaatatccctgtgattcatgtgtttcgcagacgagtaactgatccaagcttaattttcaaacagcttcccaaaaagctgtatcctgaatatcataaagtctatcatatgatgtgtactcagtcatattctgtagactcaaatcttttatctgattataccagctttcccgagcaccgtgtgctttcctttaagtcggacatgaaatgtgttctccaaagcgtttctggattgaagaaaatatttaagctgtctgcagcagtagtattgataggttctcatcctaatctgtcttttctgaaggatcaagggtgttacctaggccataagtcaagccagccaatcacatgtaagggtaatcctgtggaaatagatacatatacctatgagtgtattaaagaagccaacctttttgcattgggtcctttggttggagacaattttgttcgatttttaaagggaggggcgctgggtgttacacgctgtttagctacaagacagaagaaaaagcatttgtttgttgaaagaggaggaggagatgggatagcttaaagcaagtttacaagtaattaaaatggacagtttgccattaaagatttttaatagtggttttgcagtgtactggcttgaattttctggacttgagttaactgaaggagagcctcaaactatagtaacttcatttttaaaagttactagaatttggtatcctgatttatattgcagtgtttcaaaggtgtcactgtcagacaaatagaaacactgccaacttggtgtaacttaagctttcatttaactaaaacattcttttcttgcaaaacttatttttcatgatcatttttggttatttattatacttgattccaaaatagtacagccttgaatctataaaactgtgcagtcattatgccagaaattatcttaaatatataatgggtcaccttgctgttcaaagggtggtgcaaggtcctgcagcatcttacatctgtagcttgttagaaatgtaaactctcaggccccacaacttacttcctgcattttaacaagatccccaagggatatgtatgctcataaaaatttgagacactggtttaaatgaaaatggatataaggtatgtataactgggggtggggtgagggtaggaggcatttacaactcagattttatttattttgaaattatcaattgtataaatctaatttattaccaaatagggtcttttaaaaaatatttttatcgttgaaaccttgacaggtacttcatattcttctaataatttaaacagtccaataatgtggtatacactttgacatccaagaactcaccaagatgtttttcagagatttattctcgatttaactatcatagcatttaatgaatctgatttgtagttcaataaattgtgggttgaactacttatccctgtgtgaacattgaattactttctgtcactgaaactgaggtatttgggtgtggtaagtacttcgaaaattgtaatactgtttgggcattgtctaaattattaaaggttaaaatagaaaataaagtcagaatttttcttttccattccaaaggtgtacttagagatctctattagtattcattcgagatgacatagcagctcatatcatggttgtttattggatttatctgttctaattatataagtgtgtttactgtctgtgttttcacacaaactgctagaatttttaatgttaagacgaaaacatctgaagttctccatggcaaattgaatttttcagtcattttcttttctttttttggtacaattacttcatctggaatgtcttcattgaactcgttattctatttttcttagaattaaaagtggattaatgtgggtttttctgttcattttattgcagtattaaatgcttaagcttattaggaccataattcactttaaatataattgtatagaatatatttgcgtcgatcaaataattgcttcagatgaattcttagactcttgataatatcacacctaatttaacttgattttacaagctgtacaatccagttttagttttctattgtgataataacttttttcaaaccagtttcacatcttaatgaaataacattctctgactgcacttgcttcagtactctcttgcctgcctgtttttgacctctgcatgagttggattagatgtttttcttactgtcacttctaaatagaaaatgacagtgttataaaaaagggaaggataaaacctttgacatccccttgtgtctcaaaagtccacagttattcaaacaatggctttttttgtgatgagagtatttgttaaaaaaaaaaaaagacttcaagaaaaataaaagttcagtggagctgcaaataaatctggtgaataatttcatctttggtaatctcccatttcctgagttcttcctcaatccaagctgtcctgtgtagtatataacatttgggcattttctctgatatactatactctcatgttctataaatttctgtcccgtaattctaacactttacattttttctttgctatcagctatagctattcatggaagggaagaatcactaaatacttgtctagttatagcatgatgtgagcatctcctccttatccctcgatgcctggcttggtgtctggcaaacagtccataattagcagatgttgaaagaccgtttacaaagcagaatttggggatttaaagtgcaatgatacaacaaaaagatttaattacagcttccagtgttttgactatgtgaaccatatccaactacttttttgaaaatctagttctatgtaatatatttctgtggcatcaaattttagttgattgtattagtcaataggaagtggtggaaaatttctaaataaattcaactattaaataaatgcaagttccactaaatcttagtgtttggaacactgaagaacccagaatgaaacaaaattagactgaatgtaaatgtcatttaaaaatctaact

SEQ ID NO: 437323 - DNA, 3224 bp, Homo sapiens
  misc_feature (2938)..(2938): n is a, c, g, or t
  misc_feature (3065)..(3065): n is a, c, g, or t
  misc_feature (3070)..(3070): n is a, c, g, or t
cgccccgctccgcccctatcgcggcgccccgagatcacccgcctccggcgcctggctccctgcaggcgaggagcggaagccgctatctggaggcggactccggcgccacagagccggggcagccgcggcaacggcgaggcgcgaggcaggggcgcccggcagaccccgagaccccgagccagcgggcgccccgagcgggcagcctcgccgggggaggcggaggcggcacggcggccgcgctcgggcgcccctcgcgcagcgctccatgcccgtgtggtgctgccgctgctccctggccggtcatttcagaaactatagtgacactgaaactgaaggagagatttttaattccttagtgcaatactttggtgacaacttggggcgaaaagttaaagcgatgccattagttgaagaaacttctttactggaagattcgtcagtgacttttcctgtggtaataataggaaatggaccctcaggaatatgcctttcttatatgttatcaggctacagaccgtatttatcatcagaagcaatacacccaaatacaatcttaaatagtaaattagaagaagcaagacatctttccattgttgatcaggacttagaatacttgtctgagggccttgagggccgatcatccaatccagttgcagtacttttcgatacacttcttcatccagatgctgactttgggtatgattatccatccgttttgcattggaaattagagcaacatcattatatccctcacgtagttcttggtaaaggtccacctggtggggcttggcataatatggaaggctccatgttgacaatcagctttggaagttggatggaactacctggacttaaatttaaggactgggtatcaagtaaacgaaggagcctaaaaggggatcgagttatgccagaggaaatagctcgctactataaacattatgtaaaagtcatgggtcttcagaagaatttcagagagaatacttacataacttccgtatcaagactctacagagatcaagatgatgatgatattcaagacagagatatttcaacaaagcatttacagatagagaagtcaaactttatcaagagaaactgggaaattaggggttatcagcgaatagctgatggttctcatgttcccttctgcctctttgctgagaatgtagcgctggcaactggaacgctggattctcctgcccatctggaaattgaaggggaagattttccttttgtgtttcattcaatgcctgaatttggagctgctataaacaaaggaaagttgcgtggcaaagtggatccagtgttaattgtaggttctgggcttactgccgctgacgcagtactgtgtgcttacaacagtaatatccctgtgattcatgtgtttcgcagacgagtaactgatccaagcttaattttcaaacagcttcccaaaaagctgtatcctgaatatcataaagtctatcatatgatgtgtactcagtcatattctgtagactcaaatcttttatctgattataccagctttcccgagcaccgtgtgctttcctttaagtcggacatgaaatgtgttctccaaagcgtttctggattgaagaaaatatttaagctgtctgcagcagtagtattgataggttctcatcctaatctgtcttttctgaaggatcaagggtgttacctaggccataagtcaagccagccaatcacatgtaagggtaatcctgtggaaatagatacatatacctatgagtgtattaaagaagccaacctttttgcattgggtcctttggttggagacaattttgttcgatttttaaagggaggggcgctgggtgttacacgctgtttagctacaagacagaagaaaaagcatttgtttgttgaaagaggaggaggagatgggatagcttaaagcaagtttacaagtaattaaaatggacagtttgccattaaagatttttaatagtggttttgcagtgtactggcttgaattttctggacttgagttaactgaaggagagcctcaaactatagtaacttcatttttaaaagttactagaatttggtatcctgatttatattgcagtgtttcaaaggtgtcactgtcagacaaatagaaacactgccaacttggtgtaacttaagctttcatttaactaaaacattcttttcttgcaaaacttatttttcatgatcatttttggttatttattatacttgattccaaaatagtacagccttgaatctataaaactgtgcagtcattatgccagaaattatcttaaatatataatgggtcaccttgctgttcaaagggtggtgcaaggtcctgcagcatcttacatctgtagcttgttagaaatgtaaactctcaggccccacaacttacttcctgcattttaacaagatccccaagggatatgtatgctcataaaaatttgagacactggtttaaatgaaaatggatataaggtatgtataactgggggtggggtgagggtaggaggcatttacaactcagattttatttattttgaaattatcaattgtataaatctaatttattaccaaatagggtcttttaaaaaatatttttatcgttgaaaccttgacaggtacttcatattcttctaataatttaaacagtccaataatgtggtatacactttgacatccaagaactcaccaagatgtttttcagagatttattctcgatttaactatcataaggccccaaatttttaaacttgggaaaattccttgggaagttttggtagttcaataaatgtgggttgaactacttatccctgtgtgaacattgaatttacctttttttccccttgggtcactttggaaagaaacacctttgggaaggttaaattttctatgggctcgtagggtaagtaacttcgacaaaatcgttaatacttgttgngggcattgtctacaattattacaaggttaacaataggaaaaataaaagctccaagggaaaattttttttttcccttttttttttcccccaatttccccaaaagggtgtactttcacgagattctccntaatntacgtattcccattttcccggaaacgaaattggggaaaacccccaaatttttaaaagggggcccacaaaggggcctttcccaaatttaatttccaaaattgggggcttttgctgttctaactttcgggggaaacttttcttaattccttgggtc

SEQ ID NO: 437324 - DNA, 4349 bp, Homo sapiens
cgccccgctccgcccctatcgcggcgccccgagatcacccgcctccggcgcctggctccctgcaggcgaggagcggaagccgctatctggaggcggactccggcgccacagagccggggcagccgcggcaacggcgaggcgcgaggcaggggcgcccggcagaccccgagaccccgagccagcgggcgccccgagcgggcagcctcgccgggggaggcggaggcggcacggcggccgcgctcgggcgcccctcgcgcagcgctccatgcccgtgtggtgctgccgctgctccctggccggtcatttcagaaactatagtgacactgaaactgaaggagagatttttaattccttagtgcaatactttggtgacaacttggggcgaaaagttaaagcgatgccattagttgaagaaacttctttactggaagattcgtcagtgacttttcctgtggtaataataggaaatggaccctcaggaatatgcctttcttatatgttatcaggctacagaccgtatttatcatcagaagcaatacacccaaatacaatcttaaatagtaaattagaagaagcaagacatctttccattgttgatcaggacttagaatacttgtctgagggccttgagggccgatcatccaatccagttgcagtacttttcgatacacttcttcatccagatgctgactttgggtatgattatccatccgttttgcattggaaattagagcaacatcattatatccctcacgtagttcttggtaaaggtccacctggtggggcttggcataatatggaaggctccatgttgacaatcagctttggaagttggatggaactacctggacttaaatttaaggactgggtatcaagtaaacgaaggagcctaaaaggggatcgagttatgccagaggaaatagctcgctactataaacattatgtaaaagtcatgggtcttcagaagaatttcagagagaatacttacataacttccgtatcaagactctacagagatcaagatgatgatgatattcaagacagagatatttcaacaaagcatttacagatagagaagtcaaactttatcaagagaaactgggaaattaggggttatcagcgaatagctgatggttctcatgttcccttctgcctctttgctgagaatgtagcgctggcaactggaacgctggattctcctgcccatctggaaattgaaggggaagattttccttttgtgtttcattcaatgcctgaatttggagctgctataaacaaaggaaagttgcgtggcaaagtggatccagtgttaattgtaggttctgggcttactgccgctgacgcagtactgtgtgcttacaacagtaatatccctgtgattcatgtgtttcgcagacgagtaactgatccaagcttaattttcaaacagcttcccaaaaagctgtatcctgaatatcataaagtctatcatatgatgtgtactcagtcatattctgtagactcaaatcttttatctgattataccagctttcccgagcaccgtgtgctttcctttaagtcggacatgaaatgtgttctccaaagcgtttctggattgaagaaaatatttaagctgtctgcagcagtagtattgataggttctcatcctaatctgtcttttctgaaggatcaagggtgttacctaggccataagtcaagccagccaatcacatgtaagggtaatcctgtggaaatagatacatatacctatgagtgtattaaagaagccaacctttttgcattgggtcctttggttggagacaattttgttcgatttttaaagggaggggcgctgggtgttacacgctgtttagctacaagacagaagaaaaagcatttgtttgttgaaagaggaggaggagatgggatagcttaaagcaagtttacaagtaattaaaatggacagtttgccattaaagatttttaatagtggttttgcagtgtactggcttgaattttctggacttgagttaactgaaggagagcctcaaactatagtaacttcatttttaaaagttactagaatttggtatcctgatttatattgcagtgtttcaaaggtgtcactgtcagacaaatagaaacactgccaacttggtgtaacttaagctttcatttaactaaaacattcttttcttgcaaaacttatttttcatgatcatttttggttatttattatacttgattccaaaatagtacagccttgaatctataaaactgtgcagtcattatgccagaaattatcttaaatatataatgggtcaccttgctgttcaaagggtggtgcaaggtcctgcagcatcttacatctgtagcttgttagaaatgtaaactctcaggccccacaacttacttcctgcattttaacaagatccccaagggatatgtatgctcataaaaatttgagacactggtttaaatgaaaatggatataaggtatgtataactgggggtggggtgagggtaggaggcatttacaactcagattttatttattttgaaattatcaattgtataaatctaatttattaccaaatagggtcttttaaaaaatatttttatcgttgaaaccttgacaggtacttcatattcttctaataatttaaacagtccaataatgtggtatacactttgacatccaagaactcaccaagatgtttttcagagatttattctcgatttaactatcatagcatttaatgaatctgatttgtagttcaataaattgtgggttgaactacttatccctgtgtgaacattgaattactttctgtcactgaaactgaggtatttgggtgtggtaagtacttcgaaaattgtaatactgtttgggcattgtctaaattattaaaggttaaaatagaaaataaagtcagaatttttcttttccattccaaaggtgtacttagagatctctattagtattcattcgagatgacatagcagctcatatcatggttgtttattggatttatctgttctaattatataagtgtgtttactgtctgtgttttcacacaaactgctagaatttttaatgttaagacgaaaacatctgaagttctccatggcaaattgaatttttcagtcattttcttttctttttttggtacaattacttcatctggaatgtcttcattgaactcgttattctatttttcttagaattaaaagtggattaatgtgggtttttctgttcattttattgcagtattaaatgcttaagcttattaggaccataattcactttaaatataattgtatagaatatatttgcgtcgatcaaataattgcttcagatgaattcttagactcttgataatatcacacctaatttaacttgattttacaagctgtacaatccagttttagttttctattgtgataataacttttttcaaaccagtttcacatcttaatgaaataacattctctgactgcacttgcttcagtactctcttgcctgcctgtttttgacctctgcatgagttggattagatgtttttcttactgtcacttctaaatagaaaatgacagtgttataaaaaagggaaggataaaacctttgacatccccttgtgtctcaaaagtccacagttattcaaacaatggctttttttgtgatgagagtatttgttaaaaaaaaaaaaagacttcaagaaaaataaaagttcagtggagctgcaaataaatctggtgaataatttcatctttggtaatctcccatttcctgagttcttcctcaatccaagctgtcctgtgtagtatataacatttgggcattttctctgatatactatactctcatgttctataaatttctgtcccgtaattctaacactttacattttttctttgctatcagctatagctattcatggaagggaagaatcactaaatacttgtctagttatagcatgatgtgagcatctcctccttatccctcgatgcctggcttggtgtctggcaaacagtccataattagcagatgttgaaagaccgtttacaaagcagaatttggggatttaaagtgcaatgatacaacaaaaagatttaattacagcttccagtgttttgactatgtgaaccatatccaactacttttttgaaaatctagttctatgtaatatatttctgtggcatcaaattttagttgattgtattagtcaataggaagtggtggaaaatttctaaataaattcaactattaaataaatgcaagttccactaaatcttagtgtttggaacactgaagaacccagaatgaaacaaaattagactgaatgtaaatgtcatttaaaaatctaact

SEQ ID NO: 437325 - DNA, 3211 bp, Homo sapiens
tcatcagtcggtaccaacagacagtgtcttgaatggacaaaaaatcatgaatttcatatcagtttaatagcctgagctgggtaatggtcttactctgaccctgtggaaaagatgcctgaatttggagctgctataaacaaaggaaagttgcgtggcaaagtggatccagtgttaattgtaggttctgggcttactgccgctgacgcagtactgtgtgcttacaacagtaatatccctgtgattcatgtgtttcgcagacgagtaactgatccaagcttaattttcaaacagcttcccaaaaagctgtatcctgaatatcataaagtctatcatatgatgtgtactcagtcatattctgtagactcaaatcttttatctgattataccagctttcccgagcaccgtgtgctttcctttaagtcggacatgaaatgtgttctccaaagcgtttctggattgaagaaaatatttaagctgtctgcagcagtagtattgataggttctcatcctaatctgtcttttctgaaggatcaagggtgttacctaggccataagtcaagccagccaatcacatgtaagggtaatcctgtggaaatagatacatatacctatgagtgtattaaagaagccaacctttttgcattgggtcctttggttggagacaattttgttcgatttttaaagggaggggcgctgggtgttacacgctgtttagctacaagacagaagaaaaagcatttgtttgttgaaagaggaggaggagatgggatagcttaaagcaagtttacaagtaattaaaatggacagtttgccattaaagatttttaatagtggttttgcagtgtactggcttgaattttctggacttgagttaactgaaggagagcctcaaactatagtaacttcatttttaaaagttactagaatttggtatcctgatttatattgcagtgtttcaaaggtgtcactgtcagacaaatagaaacactgccaacttggtgtaacttaagctttcatttaactaaaacattcttttcttgcaaaacttatttttcatgatcatttttggttatttattatacttgattccaaaatagtacagccttgaatctataaaactgtgcagtcattatgccagaaattatcttaaatatataatgggtcaccttgctgttcaaagggtggtgcaaggtcctgcagcatcttacatctgtagcttgttagaaatgtaaactctcaggccccacaacttacttcctgcattttaacaagatccccaagggatatgtatgctcataaaaatttgagacactggtttaaatgaaaatggatataaggtatgtataactgggggtggggtgagggtaggaggcatttacaactcagattttatttattttgaaattatcaattgtataaatctaatttattaccaaatagggtcttttaaaaaatatttttatcgttgaaaccttgacaggtacttcatattcttctaataatttaaacagtccaataatgtggtatacactttgacatccaagaactcaccaagatgtttttcagagatttattctcgatttaactatcatagcatttaatgaatctgatttgtagttcaataaattgtgggttgaactacttatccctgtgtgaacattgaattactttctgtcactgaaactgaggtatttgggtgtggtaagtacttcgaaaattgtaatactgtttgggcattgtctaaattattaaaggttaaaatagaaaataaagtcagaatttttcttttccattccaaaggtgtacttagagatctctattagtattcattcgagatgacatagcagctcatatcatggttgtttattggatttatctgttctaattatataagtgtgtttactgtctgtgttttcacacaaactgctagaatttttaatgttaagacgaaaacatctgaagttctccatggcaaattgaatttttcagtcattttcttttctttttttggtacaattacttcatctggaatgtcttcattgaactcgttattctatttttcttagaattaaaagtggattaatgtgggtttttctgttcattttattgcagtattaaatgcttaagcttattaggaccataattcactttaaatataattgtatagaatatatttgcgtcgatcaaataattgcttcagatgaattcttagactcttgataatatcacacctaatttaacttgattttacaagctgtacaatccagttttagttttctattgtgataataacttttttcaaaccagtttcacatcttaatgaaataacattctctgactgcacttgcttcagtactctcttgcctgcctgtttttgacctctgcatgagttggattagatgtttttcttactgtcacttctaaatagaaaatgacagtgttataaaaaagggaaggataaaacctttgacatccccttgtgtctcaaaagtccacagttattcaaacaatggctttttttgtgatgagagtatttgttaaaaaaaaaaaaagacttcaagaaaaataaaagttcagtggagctgcaaataaatctggtgaataatttcatctttggtaatctcccatttcctgagttcttcctcaatccaagctgtcctgtgtagtatataacatttgggcattttctctgatatactatactctcatgttctataaatttctgtcccgtaattctaacactttacattttttctttgctatcagctatagctattcatggaagggaagaatcactaaatacttgtctagttatagcatgatgtgagcatctcctccttatccctcgatgcctggcttggtgtctggcaaacagtccataattagcagatgttgaaagaccgtttacaaagcagaatttggggatttaaagtgcaatgatacaacaaaaagatttaattacagcttccagtgttttgactatgtgaaccatatccaactacttttttgaaaatctagttctatgtaatatatttctgtggcatcaaattttagttgattgtattagtcaataggaagtggtggaaaatttctaaataaattcaactattaaataaatgcaagttccactaaatcttagtgtttggaacactgaagaacccagaatgaaacaaaattagactgaatgtaaatgtcatttaaaaatctaact

SEQ ID NO: 437326 - DNA, 6124 bp, Homo sapiens
tcaaaggggcacgagggccagcaatggcagcagcagcggcgggcagtctgcccaagtgtcttaggaaccaaaagcaaataaaagtgtttccatatatgccaccagccaagtggccatcctaattcagaaagaagctagcctttgagtgtctgtcatggtgcatccgtttcagtattatttcctaaaatgagaagcccctgtgtcaacaagatccaggggctggagcccaatgccaagcctgtgttgtccccagcgaccctgcagctgctcgctctgatgtaccctgtgccattcaaggagatgtggtccaggaaagtgagcctcatggttttcagagaagtcattgttctgtttacattttcataaaacctgtttaaaatagctccccgtctcaggctttcagcagtaacagtgagctgactggcaagttcgatgttagctcccgggacactcagcagcgatggtgagcattttggtttccttaaggcccagcaagacttccagggacatctctggtgaagccagaatggagacacccgtgacctcaggctgaaagtcactcgacattggtctcttgtgttgatagggaaggaaatcaggcattcctatttctttaaataacaaaaccactaattgccactcaatgctggaatattttgggtcacctaatcatagatttctcagggcatcaatactcaaatataggctgattatgccccagttcaaatgggaactattaacagagtgcatttcttgcttgctgggtttcaacagacatcagccaaaagaacaaaagagatgtcaggacagattccaggagtgtcggagcacatgtgtggcacccgctccctctggcagcgaatgtaggaagtcgccaaatttacccactcttcaacaagtcattgtttaaacacggtttttcattttctcaacttttaatagcaaaaagtgccaaagtcctcagagacctaacagccttggtctaccgtgctgaccagggtgaaggcacggcgagggactcctcccagacgtgcctcttgtgtgccagctggctgtggctcgggagcagacgcaggcctctccattgtccaggggagcctggcggcgcatccctcctctcccacctcctggcacttccagctgggtgtcccacatgttggattccgtccccaccacacttccagagaccggagaactgtgcagggcctaaggccgtttggatgaattgtcaaaacaagatgcttccagttacagcggcaggagcgggactgggagcacgggctgacggctgctggtgcctttcttcccacctcgcttgcctgtttccgcttgacccttcctccagctccgatgagaagagtataaagcatcttcctaacgggtgtgtttgctatacgaacataatggacgtgaagtggggcagaaacccagaactcagcattcaaggatgcccaggagagctgtccctgttttaaagagctgtgttttgttttgtttcgcatttagagagcagacaaggcacccttctgctgcgctgatacgtttcttacactgggccattttagacccccagggaaacagccttcctggagcgttgtctggaggttccagggacagggcagcctcccagagccgagcaagagctcaaggtacaaatgagagatttgctataccgtgagaagtcaacaacttagccaccacttccccgcaatggaccatgtaacaaatacctcagcaggccctgcaaaaggccatgctagagctgaggcgcacagcctgtggcctctgtagttagggcaggtgggatggagactccttgagtgcacacacctgagcctgcccacacacaggggagcagcatctcgtatgacgtctggaaggaacttcggttgtgtaaagggagccttgaagatacgtgcaaaaggtgctaccccaatttggtgaaactgacattgggcacgtcttgggcttaggagaagcggccgatggtcccggcctgcagtgacaaacccccctccccgcaccgcccccagcaccccctctcctcttcacctcttcctgctggccacgaggaagccacttcctcagagagaccctaccagatgcggatggaaacagatgcaccaaagcaagccctgatgaaaccgcgacttcctaaggtctgtctcctctgaacttgcacctgggcctctctgtgtttggttccaagcacttcccacctcaaactcccattttcaaaccactgtatctctgcgcacatctgctacttaccagccgcatacatgatggagggttttttggtcctgatccagtggccacacctgtctttgaaatgtctcactgaactccagttttaaaatagattcattgcttcaacacagcaagcccaatgcacccagctaagactggcttgaccgacagcctggcctttggtggggggcttcctggggcctggggaaagctggccaccttcaacagctggtacctcttcaacagtgtggcctttcaaaatgcagatgccaccaggagaacatgcccacagctcaccacctatggatgccatggctctgggcagctttcaaagcaggttcctgtggtctcctcagctgtttgagggggtaacagcaaatcagcctccattttaaaatgaaaacaccagcctccagatgtagggcctgctgggtgttgctagccgctggtccccaggcacggtgcactttctccacctcctgcagcctccctgttgtttctagactcttgcacctggtgagtgcaaggataggtgacccaggggcctgcagccttgtcctcagctcccatctcctggactgccagcctcaccctctgcagttagcatggttggcctgatgcagggatcccgagggattactttttagaccttctttcacattcagaaaagtagtatagattcaggagaggcaagaaaattatgctgtccatagaagtcacccatgaagactgatgccaccacctgaaggctcatgattgttaaaaatgtccacgggaacctctcgtccacaggaggtttgtctcaacacttcccatttttacggcattggcattgccaagcatggggaagtatctgctcttctcatgttaaaagtggcccagcttttcttaactcagtccaagctgacttgtttagctgcactggaatttcttaccaaccaaatatttgcatcgagcaaagggggctgtgtgcacctccctaatggcagcgatgatggctgctgtcattcaagcccatcttcagacgtcacagtctggaagtgaaatgtccacaaacatctgtggcagaaaaggctatacggaccacccagttgtgctgcagctttacagagcaaggaagggttgtggcaaataaatgattaacctgcctcgactgtgctgagggcaacaaaggccatctcaccaaaggattattcgatgccattaaatcatcccgtgaccttcctgcttccgagtccatggcctttgcccagggcatgtactcccctgagaggccttctgcctagaaagatctatgactgggttccaaagttgaggcctaggtttttgctgggatttagatattttcaggcaccattttgacagcattcaggaaaacggttattgaccccatagactagggtaagaataaaggcaataaatttggtctgactcagaatataggagatccatatatttctctggaaaccacagtgtacactaaaatgtgaaattgaaggttttgttaaaaagaaaaagataatgagcttcatgctttgtttaattacataatgatttccattacgctatttctgtgaaatgcagcaggttcttaaacgttatttcagtggcatgggctggaagcttatcacaaaaagccatgtgtgtggccttatcagaacagaaagagacaggctggtgcccaaggctgctgcctgctccaccttttgccagctctggacatctgaggacgtcccggcagatctggaatggggccctcaactgaccatttgcttctcagaatttcagtttgagacatgagaggtataatcagttacttttctccccccagagaaacccttttgtgaggggagaggagctatggtatgtggttcagctgaaacacatacaactgcatccttttggagtcctttgccaacaaaaacagaccaacagaccagatggtgtccatgttcaatatcatgtcttgatggacgcagctgatgacctcaaatacttgagtggtctcatggctgttagatggattatttgaaaaaaaaaaaaaaaaaagagagaaaaaataattgatttttacatcagagatagcaaactaagacctggggaggggggtcagcttttattttattttattttttttaagtttgctagttgggtcaaatgtgaggaggagggagtctacctgccacctcttctcttgcccctcttctgcccacacatccagcatccaaaatccattcatttaatgaattgataaagtgccgtgcaaactggtgcacaaacaggcccccagtccacgcagcctggctcctaggaaaagtggtgaccgggcgtgggggggcatgccgcagccctgggacacagtcgggcaccttccccggacccccaggccttggctgtgcctcaagtcagagagggtcagccttcaggccccggagacgagtgactggccgatcatttcacaataaaatcactcacttttggcaacttcactttttttaaggcacagtcagttccttttctcatgtacctcacaaaagatgaagaccatgtagtactctttttggtaaagttacagtgttcatgttaaatatcacttttttctacattgtgtggtaaaaagaactacgttaatagctatatcttaaatactgtgatttgactttttgaaaaatatcctaatacaaatattttactaacttacaatcactcatttaataagaaacatttggattcttttgaaatcagtgttaattgactcatattcttaaaagcctggctcttgaccctattggaaacacaaaggaagctgaaatcaaacatctaaaatacactgcgtacacgtgtgcgtgcacacacacacacacacacacacacacacagctcttcatttctcctgagccatgcagaatttactttcaatgtggaaatctgttccctttaccacactgtatatgcacagagcacaagagaggctatctctagtcacttccaccagcgaggccttaggactccgtattagaggccaccgatttcatacaacagtgtttcgctaaagacccttcactattcttgtttagtaaatagctgtctgctcttcagggaactgttacctatgggttattaccaaagaacgctggcaattggaaatgtcctgatggaaattctttgcacgtgccggttctctggcatcctccaggtggcccaacccaaagcagaaagcagaaaccacagaccccgtgagtctccccataccttgtttccaataacttggcaaaacttcttggtgcatattggttacaccctctgggattcataatgccattaggctaaaaccctaagagagagggttgacagaaacacacgcgagaatgaggcagatcccagagcaaggactgggcccagactctccacatgtgctctactagtgagtgccttatactctcagtattttggggcttacagcttcttatttgtgctaaaaaggtgcagttccaaagtaggaactgccacacaggccccagcatcctctctccaacttcatacctctctcctggtggggggagcgggcatccaggacctccggaatcaaggatgtgcagagaagagcgaaagtaatttttctagtcacatgaactgattggttccaggcaattagaaaatggctataaaataaccttaattttaaaaaaaaatcttgggtcttcgttttcctattaggagactgaactgaccacatgtattgatttatatcctgaatatatgggaacttctgtgtttgggatgtcctactgtaagactgatgaatgtacagagttaatttcagggtacagttttgccttaatggttttaaaaaataaactattttttaaaattt

SEQ ID NO: 437327 - DNA, 6070 bp, Homo sapiens
tcaaaggggcacgagggccagcaatggcagcagcagcggcgggcagtctgcccaagtgtcttaggaaccaaaagcaaataaaagtgtttccatatatgccaccagccaagtggccatcctaattcagaaagaagctagcctttgagtgtctgtcatggtgcatccgtttcagtattatttcctaaaatgagaagcccctgtgtcaacaagatccaggggctggagcccaatgccaagcctgtgttgtccccagcgaccctgcagctgctcgctctgatgtaccctgtgccattcaaggagatgtggtccaggaaagtgagcctcatggttttcagagaagtcattgttctgtttacattttcataaaacctgtttaaaatagctccccgtctcaggctttcagcagtaacagtgagctgactggcaagttcgatgttagctcccgggacactcagcagcgatggtgagcattttggtttccttaaggcccagcaagacttccagggacatctctggtgaagccagaatggagacacccgtgacctcaggctgaaagtcactcgacattggtctcttgtgttgatagggaaggaaatcaggcattcctatttctttaaataacaaaaccactaattgccactcaatgctggaatattttgggtcacctaatcatagatttctcagggcatcaatactcaaatataggctgattatgccccagttcaaatgggaactattaacagagtgcatttcttgcttgctgggtttcaacagacatcagccaaaagaacaaaagagatgtcaggacagattccaggagtgtcggagcacatgtgtggcacccgctccctctggcagcgaatgtaggaagtcgccaaatttacccactcttcaacaagtcattgtttaaacacggtttttcattttctcaacttttaatagcaaaaagtgccaaagtcctcagagacctaacagccttggtctaccgtgctgaccagggtgaaggcacggcgagggactcctcccagacgtgcctcttgtgtgccagctggctgtggctcgggagcagacgcaggcctctccattgtccaggggagcctggcggcgcatccctcctctcccacctcctggcacttccagctgggtgtcccacatgttggattccgtccccaccacacttccagagaccggagaactgtgcagggcctaaggccgtttggatgaattgtcaaaacaagatgcttccagttacagcggcaggagcgggactgggagcacgggctgacggctgctggtgcctttcttcccacctcgcttgcctgtttccgcttgacccttcctccagctccgatgagaagagtataaagcatcttcctaacgggtgtgtttgctatacgaacataatggacgtgaagtggggcagaaacccagaactcagcattcaaggatgcccaggagagctgtccctgttttaaagagctgtgttttgttttgtttcgcatttagagagcagacaaggcacccttctgctgcgctgatacgtttcttacactgggccattttagacccccagggaaacagccttcctggagcgttgtctggaggttccagggacagggcagcctcccagagccgagcaagagctcaaggtacaaatgagagatttgctataccgtgagaagtcaacaacttagccaccacttccccgcaatggaccatgtaacaaatacctcagcaggccctgcaaaaggccatgctagagctgaggcgcacagcctgtggcctctgtagttagggcaggtgggatggagactccttgagtgcacacacctgagcctgcccacacacaggggagcagcatctcgtatgacgtctggaaggaacttcggttgtgtaaagggagccttgaagatacgtgcaaaaggtgctaccccaatttggtgaaactgacattgggcacgtcttgggcttaggagaagcggccgatggtcccggcctgcagtgacaaacccccctccccgcaccgcccccagcaccccctctcctcttcacctcttcctgctggccacgaggaagccacttcctcagagagaccctaccagatgcggatggaaacagatgcaccaaagcaagccctgatgaaaccgcgacttcctaaggtctgtctcctctgaacttgcacctgggcctctctgtgtttggttccaagcacttcccacctcaaactcccattttcaaaccactgtatctctgcgcacatctgctacttaccagccgcatacatgatggagggttttttggtcctgatccagtggccacacctgtctttgaaatgtctcactgaactccagttttaaaatagattcattgcttcaacacagcaagcccaatgcacccagctaagactggcttgaccgacagcctggcctttggtggggggcttcctggggcctggggaaagctggccaccttcaacagctggtacctcttcaacagtgtggcctttcaaaatgcagatgccaccaggagaacatgcccacagctcaccacctatggatgccatggctctgggcagctttcaaagcaggttcctgtggtctcctcagctgtttgagggggtaacagcaaatcagcctccattttaaaatgaaaacaccagcctccagatgtagggcctgctgggtgttgctagccgctggtccccaggcacggtgcactttctccacctcctgcagcctccctgttgtttctagactcttgcacctggtgagtgcaaggataggtgacccaggggcctgcagccttgtcctcagctcccatctcctggactgccagcctcaccctctgcagttagcatggttggcctgatgcagggatcccgagggattactttttagaccttctttcacattcagaaaagtagtatagattcaggagaggcaagaaaattatgctgtccatagaagtcacccatgaagactgatgccaccacctgaaggctcatgattgttaaaaatgtccacgggaacctctcgtccacaggaggtttgtctcaacacttcccatttttacggcattggcattgccaagcatggggaagtatctgctcttctcatgttaaaagtggcccagcttttcttaactcagtccaagctgacttgtttagctgcactggaatttcttaccaaccaaatatttgcatcgagcaaagggggctgtgtgcacctccctaatggcagcgatgatggctgctgtcattcaagcccatcttcagacgtcacagtctggaagtgaaatgtccacaaacatctgtggcagaaaaggctatacggaccacccagttgtgctgcagctttacagagcaaggaagggttgtggcaaataaatgattaacctgcctcgactgtgctgagggcaacaaaggccatctcaccaaaggattattcgatgccattaaatcatcccgtgaccttcctgcttccgagtccatggcctttgcccagggcatgtactcccctgagaggccttctgcctagaaagatctatgactgggttccaaagttgaggcctaggtttttgctgggatttagatattttcaggcaccattttgacagcattcaggaaaacggttattgaccccatagactagggtaagaataaaggcaataaatttggtctgactcagaatataggagatccatatatttctctggaaaccacagtgtacactaaaatgtgaaattgaaggttttgttaaaaagaaaaagataatgagcttcatgctttgtttaattacataatgatttccattacgctatttctgtgaaatgcagcaggttcttaaacgttatttcagtggcatgggctggaagcttatcacaaaaagccatgtgtgtggccttatcagaacagaaagagacaggctggtgcccaaggctgctgcctgctccaccttttgccagctctggacatctgaggacgtcccggcagatctggaatggggccctcaactgaccatttgcttctcagaatttcagtttgagacatgagaggtataatcagttacttttctccccccagagaaacccttttgtgaggggagaggagctatggtatgtggttcagctgaaacacatacaactgcatccttttggagtcctttgccaacaaaaacagaccaacagaccagatggtgtccatgttcaatatcatgtcttgatggacgcagctgatgacctcaaatacttgagtggtctcatggctgttagatggattatttgaaaaaaaaaaaaaaaaaagagagaaaaaataattgatttttacatcagagatagcaaactaagacctggggaggggggtcagcttttattttattttattttttttaagtttgctagttgggtcaaatgtgaggaggagggagtctacctgccacctcttctcttgcccctcttctgcccacacatccagcatccaaaatccattcatttaatgaattgataaagtgccgtgcaaactggtgcacaaacaggcccccagtccacgcagcctggctcctaggcaccttccccggacccccaggccttggctgtgcctcaagtcagagagggtcagccttcaggccccggagacgagtgactggccgatcatttcacaataaaatcactcacttttggcaacttcactttttttaaggcacagtcagttccttttctcatgtacctcacaaaagatgaagaccatgtagtactctttttggtaaagttacagtgttcatgttaaatatcacttttttctacattgtgtggtaaaaagaactacgttaatagctatatcttaaatactgtgatttgactttttgaaaaatatcctaatacaaatattttactaacttacaatcactcatttaataagaaacatttggattcttttgaaatcagtgttaattgactcatattcttaaaagcctggctcttgaccctattggaaacacaaaggaagctgaaatcaaacatctaaaatacactgcgtacacgtgtgcgtgcacacacacacacacacacacacacacacagctcttcatttctcctgagccatgcagaatttactttcaatgtggaaatctgttccctttaccacactgtatatgcacagagcacaagagaggctatctctagtcacttccaccagcgaggccttaggactccgtattagaggccaccgatttcatacaacagtgtttcgctaaagacccttcactattcttgtttagtaaatagctgtctgctcttcagggaactgttacctatgggttattaccaaagaacgctggcaattggaaatgtcctgatggaaattctttgcacgtgccggttctctggcatcctccaggtggcccaacccaaagcagaaagcagaaaccacagaccccgtgagtctccccataccttgtttccaataacttggcaaaacttcttggtgcatattggttacaccctctgggattcataatgccattaggctaaaaccctaagagagagggttgacagaaacacacgcgagaatgaggcagatcccagagcaaggactgggcccagactctccacatgtgctctactagtgagtgccttatactctcagtattttggggcttacagcttcttatttgtgctaaaaaggtgcagttccaaagtaggaactgccacacaggccccagcatcctctctccaacttcatacctctctcctggtggggggagcgggcatccaggacctccggaatcaaggatgtgcagagaagagcgaaagtaatttttctagtcacatgaactgattggttccaggcaattagaaaatggctataaaataaccttaattttaaaaaaaaatcttgggtcttcgttttcctattaggagactgaactgaccacatgtattgatttatatcctgaatatatgggaacttctgtgtttgggatgtcctactgtaagactgatgaatgtacagagttaatttcagggtacagttttgccttaatggttttaaaaaataaactattttttaaaattt

SEQ ID NO: 437328 - DNA, 6070 bp, Homo sapiens
tcaaaggggcacgagggccagcaatggcagcagcagcggcgggcagtctgcccaagtgtcttaggaaccaaaagcaaataaaagtgtttccatatatgccaccagccaagtggccatcctaattcagaaagaagctagcctttgagtgtctgtcatggtgcatccgtttcagtattatttcctaaaatgagaagcccctgtgtcaacaagatccaggggctggagcccaatgccaagcctgtgttgtccccagcgaccctgcagctgctcgctctgatgtaccctgtgccattcaaggagatgtggtccaggaaagtgagcctcatggttttcagagaagtcattgttctgtttacattttcataaaacctgtttaaaatagctccccgtctcaggctttcagcagtaacagtgagctgactggcaagttcgatgttagctcccgggacactcagcagcgatggtgagcattttggtttccttaaggcccagcaagacttccagggacatctctggtgaagccagaatggagacacccgtgacctcaggctgaaagtcactcgacattggtctcttgtgttgatagggaaggaaatcaggcattcctatttctttaaataacaaaaccactaattgccactcaatgctggaatattttgggtcacctaatcatagatttctcagggcatcaatactcaaatataggctgattatgccccagttcaaatgggaactattaacagagtgcatttcttgcttgctgggtttcaacagacatcagccaaaagaacaaaagagatgtcaggacagattccaggagtgtcggagcacatgtgtggcacccgctccctctggcagcgaatgtaggaagtcgccaaatttacccactcttcaacaagtcattgtttaaacacggtttttcattttctcaacttttaatagcaaaaagtgccaaagtcctcagagacctaacagccttggtctaccgtgctgaccagggtgaaggcacggcgagggactcctcccagacgtgcctcttgtgtgccagctggctgtggctcgggagcagacgcaggcctctccattgtccaggggagcctggcggcgcatccctcctctcccacctcctggcacttccagctgggtgtcccacatgttggattccgtccccaccacacttccagagaccggagaactgtgcagggcctaaggccgtttggatgaattgtcaaaacaagatgcttccagttacagcggcaggagcgggactgggagcacgggctgacggctgctggtgcctttcttcccacctcgcttgcctgtttccgcttgacccttcctccagctccgatgagaagagtataaagcatcttcctaacgggtgtgtttgctatacgaacataatggacgtgaagtggggcagaaacccagaactcagcattcaaggatgcccaggagagctgtccctgttttaaagagctgtgttttgttttgtttcgcatttagagagcagacaaggcacccttctgctgcgctgatacgtttcttacactgggccattttagacccccagggaaacagccttcctggagcgttgtctggaggttccagggacagggcagcctcccagagccgagcaagagctcaaggtacaaatgagagatttgctataccgtgagaagtcaacaacttagccaccacttccccgcaatggaccatgtaacaaatacctcagcaggccctgcaaaaggccatgctagagctgaggcgcacagcctgtggcctctgtagttagggcaggtgggatggagactccttgagtgcacacacctgagcctgcccacacacaggggagcagcatctcgtatgacgtctggaaggaacttcggttgtgtaaagggagccttgaagatacgtgcaaaaggtgctaccccaatttggtgaaactgacattgggcacgtcttgggcttaggagaagcggccgatggtcccggcctgcagtgacaaacccccctccccgcaccgcccccagcaccccctctcctcttcacctcttcctgctggccacgaggaagccacttcctcagagagaccctaccagatgcggatggaaacagatgcaccaaagcaagccctgatgaaaccgcgacttcctaaggtctgtctcctctgaacttgcacctgggcctctctgtgtttggttccaagcacttcccacctcaaactcccattttcaaaccactgtatctctgcgcacatctgctacttaccagccgcatacatgatggagggttttttggtcctgatccagtggccacacctgtctttgaaatgtctcactgaactccagttttaaaatagattcattgcttcaacacagcaagcccaatgcacccagctaagactggcttgaccgacagcctggcctttggtggggggcttcctggggcctggggaaagctggccaccttcaacagctggtacctcttcaacagtgtggcctttcaaaatgcagatgccaccaggagaacatgcccacagctcaccacctatggatgccatggctctgggcagctttcaaagcaggttcctgtggtctcctcagctgtttgagggggtaacagcaaatcagcctccattttaaaatgaaaacaccagcctccagatgtagggcctgctgggtgttgctagccgctggtccccaggcacggtgcactttctccacctcctgcagcctccctgttgtttctagactcttgcacctggtgagtgcaaggataggtgacccaggggcctgcagccttgtcctcagctcccatctcctggactgccagcctcaccctctgcagttagcatggttggcctgatgcagggatcccgagggattactttttagaccttctttcacattcagaaaagtagtatagattcaggagaggcaagaaaattatgctgtccatagaagtcacccatgaagactgatgccaccacctgaaggctcatgattgttaaaaatgtccacgggaacctctcgtccacaggaggtttgtctcaacacttcccatttttacggcattggcattgccaagcatggggaagtatctgctcttctcatgttaaaagtggcccagcttttcttaactcagtccaagctgacttgtttagctgcactggaatttcttaccaaccaaatatttgcatcgagcaaagggggctgtgtgcacctccctaatggcagcgatgatggctgctgtcattcaagcccatcttcagacgtcacagtctggaagtgaaatgtccacaaacatctgtggcagaaaaggctatacggaccacccagttgtgctgcagctttacagagcaaggaagggttgtggcaaataaatgattaacctgcctcgactgtgctgagggcaacaaaggccatctcaccaaaggattattcgatgccattaaatcatcccgtgaccttcctgcttccgagtccatggcctttgcccagggcatgtactcccctgagaggccttctgcctagaaagatctatgactgggttccaaagttgaggcctaggtttttgctgggatttagatattttcaggcaccattttgacagcattcaggaaaacggttattgaccccatagactagggtaagaataaaggcaataaatttggtctgactcagaatataggagatccatatatttctctggaaaccacagtgtacactaaaatgtgaaattgaaggttttgttaaaaagaaaaagataatgagcttcatgctttgtttaattacataatgatttccattacgctatttctgtgaaatgcagcaggttcttaaacgttatttcagtggcatgggctggaagcttatcacaaaaagccatgtgtgtggccttatcagaacagaaagagacaggctggtgcccaaggctgctgcctgctccaccttttgccagctctggacatctgaggacgtcccggcagatctggaatggggccctcaactgaccatttgcttctcagaatttcagtttgagacatgagaggtataatcagttacttttctccccccagagaaacccttttgtgaggggagaggagctatggtatgtggttcagctgaaacacatacaactgcatccttttggagtcctttgccaacaaaaacagaccaacagaccagatggtgtccatgttcaatatcatgtcttgatggacgcagctgatgacctcaaatacttgagtggtctcatggctgttagatggattatttgaaaaaaaaaaaaaaaaaagagagaaaaaataattgatttttacatcagagatagcaaactaagacctggggaggggggtcagcttttattttattttattttttttaagtttgctagttgggtcaaatgtgaggaggagggagtctacctgccacctcttctcttgcccctcttctgcccacacatccagcatccaaaatccattcatttaatgaattgataaagtgccgtgcaaactggtgcacaaacaggcccccagtccacgcagcctggctcctaggaaaagtggtgaccgggcgtgggggggcatgccgcagccctgggacacagtcgggcaccttccccggacccccaggccttggctgtgcctcaagtcagagagggtcagccttcaggccccggagacgagtgactggccgatcatttcacaataaaatcactcacttttggcaacttcactttttttaaggcacagtcagttccttttctcatgtacctcacaaaagatgaagaccatgtagtactctttttggtaaagttacagtgttcatgttaaatatcacttttttctacattgtgtggtaaaaagaactacgttaatagctatatcttaaatactgtgatttgactttttgaaaaatatcctaatacaaatattttactaacttacaatcactcatttaataagaaacatttggattcttttgaaatcagtgttaattgactcatattcttaaaagcctggctcttgaccctattggaaacacaaaggaagctgaaatcaaacatctaaaatacactgcgtacacgtgtgcgtgcacacacacacacacacacacacacacacagctcttcatttctcctgagccatgcagaatttactttcaatgtggaaatctgttccctttaccacactgtatatgcacagagcacaagagaggctatctctagtcacttccaccagcgaggccttaggactccgtattagaggccaccgatttcatacaacagtgtttcgctaaagacccttcactattcttgtttagtaaatagctgtctgctcttcagggaactgttacctatgggttattaccaaagaacgctggcaattggaaatgtcctgatggaaattctttgcacgtgccggttctctggcatcctccaggtggcccaacccaaagcagaaagcagaaaccacagaccccgtgagtctccccataccttgtttccaataacttggcaaaacttcttggtgcatattggttacaccctctgggattcataatgccattaggctaaaaccctaagagagagggttgacagaaacacacgcgagaatgaggcagatcccagagcaaggactgggcccagactctccacatgtgctctactagtgagtgccttatactctcagtattttggggcttacagcttcttatttgtgctaaaaaggtgcagttccaaagtaggaactgccacacaggccccagcatcctctctccaacttcatacctctctcctggtggggggagcgggcatccaggacctccggaatcaaggatgtgcagagaagagcgaaagtaatttttctagtcacatgaactgattggttccaggcaattagaaaatggctataaaataaccttaattttaaaaaatttatatcctgaatatatgggaacttctgtgtttgggatgtcctactgtaagactgatgaatgtacagagttaatttcagggtacagttttgccttaatggttttaaaaaataaactattttttaaaattt

SEQ ID NO: 437329 - DNA, 4305 bp, Homo sapiens
  misc_feature (4258)..(4259): n is a, c, g, or t
tcaaaggggcacgagggccagcaatggcagcagcagcggcgggcagtctgcccaagtgtcttaggaaccaaaagcaaataaaagtgtttccatatatgccaccagccaagtggccatcctaattcagaaagaagctagcctttgagtgtctgtcatggtgcatccgtttcagtattatttcctaaaatgagaagcccctgtgtcaacaagatccaggggctggagcccaatgccaagcctgtgttgtccccagcgaccctgcagctgctcgctctgatgtaccctgtgccattcaaggagatgtggtccaggaaagtgagcctcatggttttcagagaagtcattgttctgtttacattttcataaaacctgtttaaaatagctccccgtctcaggctttcagcagtaacagtgagctgactggcaagttcgatgttagctcccgggacactcagcagcgatggtgagcattttggtttccttaaggcccagcaagacttccagggacatctctggtgaagccagaatggagacacccgtgacctcaggctgaaagtcactcgacattggtctcttgtgttgatagggaaggaaatcaggcattcctatttctttaaataacaaaaccactaattgccactcaatgctggaatattttgggtcacctaatcatagatttctcagggcatcaatactcaaatataggctgattatgccccagttcaaatgggaactattaacagagtgcatttcttgcttgctgggtttcaacagacatcagccaaaagaacaaaagagatgtcaggacagattccaggagtgtcggagcacatgtgtggcacccgctccctctggcagcgaatgtaggaagtcgccaaatttacccactcttcaacaagtcattgtttaaacacggtttttcattttctcaacttttaatagcaaaaagtgccaaagtcctcagagacctaacagccttggtctaccgtgctgaccagggtgaaggcacggcgagggactcctcccagacgtgcctcttgtgtgccagctggctgtggctcgggagcagacgcaggcctctccattgtccaggggagcctggcggcgcatccctcctctcccacctcctggcacttccagctgggtgtcccacatgttggattccgtccccaccacacttccagagaccggagaactgtgcagggcctaaggccgtttggatgaattgtcaaaacaagatgcttccagttacagcggcaggagcgggactgggagcacgggctgacggctgctggtgcctttcttcccacctcgcttgcctgtttccgcttgacccttcctccagctccgatgagaagagtataaagcatcttcctaacgggtgtgtttgctatacgaacataatggacgtgaagtggggcagaaacccagaactcagcattcaaggatgcccaggagagctgtccctgttttaaagagctgtgttttgttttgtttcgcatttagagagcagacaaggcacccttctgctgcgctgatacgtttcttacactgggccattttagacccccagggaaacagccttcctggagcgttgtctggaggttccagggacagggcagcctcccagagccgagcaagagctcaaggtacaaatgagagatttgctataccgtgagaagtcaacaacttagccaccacttccccgcaatggaccatgtaacaaatacctcagcaggccctgcaaaaggccatgctagagctgaggcgcacagcctgtggcctctgtagttagggcaggtgggatggagactccttgagtgcacacacctgagcctgcccacacacaggggagcagcatctcgtatgacgtctggaaggaacttcggttgtgtaaagggagccttgaagatacgtgcaaaaggtgctaccccaatttggtgaaactgacattgggcacgtcttgggcttaggagaagcggccgatggtcccggcctgcagtgacaaacccccctccccgcaccgcccccagcaccccctctcctcttcacctcttcctgctggccacgaggaagccacttcctcagagagaccctaccagatgcggatggaaacagatgcaccaaagcaagccctgatgaaaccgcgacttcctaaggtctgtctcctctgaacttgcacctgggcctctctgtgtttggttccaagcacttcccacctcaaactcccattttcaaaccactgtatctctgcgcacatctgctacttaccagccgcatacatgatggagggttttttggtcctgatccagtggccacacctgtctttgaaatgtctcactgaactccagttttaaaatagattcattgcttcaacacagcaagcccaatgcacccagctaagactggcttgaccgacagcctggcctttggtggggggcttcctggggcctggggaaagctggccaccttcaacagctggtacctcttcaacagtgtggcctttcaaaatgcagatgccaccaggagaacatgcccacagctcaccacctatggatgccatggctctgggcagctttcaaagcaggttcctgtggtctcctcagctgtttgagggggtaacagcaaatcagcctccattttaaaatgaaaacaccagcctccagatgtagggcctgctgggtgttgctagccgctggtccccaggcacggtgcactttctccacctcctgcagcctccctgttgtttctagactcttgcacctggtgagtgcaaggataggtgacccaggggcctgcagccttgtcctcagctcccatctcctggactgccagcctcaccctctgcagttagcatggttggcctgatgcagggatcccgagggattactttttagaccttctttcacattcagaaaagtagtatagattcaggagaggcaagaaaattatgctgtccatagaagtcacccatgaagactgatgccaccacctgaaggctcatgattgttaaaaatgtccacgggaacctctcgtccacaggaggtttgtctcaacacttcccatttttacggcattggcattgccaagcatggggaagtatctgctcttctcatgttaaaagtggcccagcttttcttaactcagtccaagctgacttgtttagctgcactggaatttcttaccaaccaaatatttgcatcgagcaaagggggctgtgtgcacctccctaatggcagcgatgatggctgctgtcattcaagcccatcttcagacgtcacagtctggaagtgaaatgtccacaaacatctgtggcagaaaaggctatacggaccacccagttgtgctgcagctttacagagcaaggaagggttgtggcaaataaatgattaacctgcctcgactgtgctgagggcaacaaaggccatctcaccaaaggattattcgatgccattaaatcatcccgtgaccttcctgcttccgagtccatggcctttgcccagggcatgtactcccctgagaggccttctgcctagaaagatctatgactgggttccaaagttgaggcctaggtttttgctgggatttagatattttcaggcaccattttgacagcattcaggaaaacggttattgaccccatagactagggtaagaataaaggcaataaatttggtctgactcagaatataggagatccatatatttctctggaaaccacagtgtacactaaaatgtgaaattgaaggttttgttaaaaagaaaaagataatgagcttcatgctttgtttaattacataatgatttccattacgctatttctgtgaaatgcagcaggttcttaaacgttatttcagtggcatgggctggaagcttatcacaaaaagccatgtgtgtggccttatcagaacagaaagagacaggctggtgcccaaggctgctgcctgctccaccttttgccagctctggacatctgaggacgtcccggcagatctggaatggggccctcaactgaccatttgcttctcagaatttcagtttgagacatgagaggtataatcagttacttttctccccccagagaaacccttttgtgaggggagaggagctatggtatgtggttcagctgaaacacatacaactgcatccttttggagtcctttttcaaataatccatctaacagccatgagaccactcaagtatttgaggtcatcagctgcgtccatcaagacatgatattgaacatggacaccatcnngtctgttggtctgtttttgttggcaaaggtcgacgcggccgcgaat

SEQ ID NO: 437330 - DNA, 6070 bp, Homo sapiens
tcaaaggggcacgagggccagcaatggcagcagcagcggcgggcagtctgcccaagtgtcttaggaaccaaaagcaaataaaagtgtttccatatatgccaccagccaagtggccatcctaattcagaaagaagctagcctttgagtgtctgtcatggtgcatccgtttcagtattatttcctaaaatgagaagcccctgtgtcaacaagatccaggggctggagcccaatgccaagcctgtgttgtccccagcgaccctgcagctgctcgctctgatgtaccctgtgccattcaaggagatgtggtccaggaaagtgagcctcatggttttcagagaagtcattgttctgtttacattttcataaaacctgtttaaaatagctccccgtctcaggctttcagcagtaacagtgagctgactggcaagttcgatgttagctcccgggacactcagcagcgatggtgagcattttggtttccttaaggcccagcaagacttccagggacatctctggtgaagccagaatggagacacccgtgacctcaggctgaaagtcactcgacattggtctcttgtgttgatagggaaggaaatcaggcattcctatttctttaaataacaaaaccactaattgccactcaatgctggaatattttgggtcacctaatcatagatttctcagggcatcaatactcaaatataggctgattatgccccagttcaaatgggaactattaacagagtgcatttcttgcttgctgggtttcaacagacatcagccaaaagaacaaaagagatgtcaggacagattccaggagtgtcggagcacatgtgtggcacccgctccctctggcagcgaatgtaggaagtcgccaaatttacccactcttcaacaagtcattgtttaaacacggtttttcattttctcaacttttaatagcaaaaagtgccaaagtcctcagagacctaacagccttggtctaccgtgctgaccagggtgaaggcacggcgagggactcctcccagacgtgcctcttgtgtgccagctggctgtggctcgggagcagacgcaggcctctccattgtccaggggagcctggcggcgcatccctcctctcccacctcctggcacttccagctgggtgtcccacatgttggattccgtccccaccacacttccagagaccggagaactgtgcagggcctaaggccgtttggatgaattgtcaaaacaagatgcttccagttacagcggcaggagcgggactgggagcacgggctgacggctgctggtgcctttcttcccacctcgcttgcctgtttccgcttgacccttcctccagctccgatgagaagagtataaagcatcttcctaacgggtgtgtttgctatacgaacataatggacgtgaagtggggcagaaacccagaactcagcattcaaggatgcccaggagagctgtccctgttttaaagagctgtgttttgttttgtttcgcatttagagagcagacaaggcacccttctgctgcgctgatacgtttcttacactgggccattttagacccccagggaaacagccttcctggagcgttgtctggaggttccagggacagggcagcctcccagagccgagcaagagctcaaggtacaaatgagagatttgctataccgtgagaagtcaacaacttagccaccacttccccgcaatggaccatgtaacaaatacctcagcaggccctgcaaaaggccatgctagagctgaggcgcacagcctgtggcctctgtagttagggcaggtgggatggagactccttgagtgcacacacctgagcctgcccacacacaggggagcagcatctcgtatgacgtctggaaggaacttcggttgtgtaaagggagccttgaagatacgtgcaaaaggtgctaccccaatttggtgaaactgacattgggcacgtcttgggcttaggagaagcggccgatggtcccggcctgcagtgacaaacccccctccccgcaccgcccccagcaccccctctcctcttcacctcttcctgctggccacgaggaagccacttcctcagagagaccctaccagatgcggatggaaacagatgcaccaaagcaagccctgatgaaaccgcgacttcctaaggtctgtctcctctgaacttgcacctgggcctctctgtgtttggttccaagcacttcccacctcaaactcccattttcaaaccactgtatctctgcgcacatctgctacttaccagccgcatacatgatggagggttttttggtcctgatccagtggccacacctgtctttgaaatgtctcactgaactccagttttaaaatagattcattgcttcaacacagcaagcccaatgcacccagctaagactggcttgaccgacagcctggcctttggtggggggcttcctggggcctggggaaagctggccaccttcaacagctggtacctcttcaacagtgtggcctttcaaaatgcagatgccaccaggagaacatgcccacagctcaccacctatggatgccatggctctgggcagctttcaaagcaggttcctgtggtctcctcagctgtttgagggggtaacagcaaatcagcctccattttaaaatgaaaacaccagcctccagatgtagggcctgctgggtgttgctagccgctggtccccaggcacggtgcactttctccacctcctgcagcctccctgttgtttctagactcttgcacctggtgagtgcaaggataggtgacccaggggcctgcagccttgtcctcagctcccatctcctggactgccagcctcaccctctgcagttagcatggttggcctgatgcagggatcccgagggattactttttagaccttctttcacattcagaaaagtagtatagattcaggagaggcaagaaaattatgctgtccatagaagtcacccatgaagactgatgccaccacctgaaggctcatgattgttaaaaatgtccacgggaacctctcgtccacaggaggtttgtctcaacacttcccatttttacggcattggcattgccaagcatggggaagtatctgctcttctcatgttaaaagtggcccagcttttcttaactcagtccaagctgacttgtttagctgcactggaatttcttaccaaccaaatatttgcatcgagcaaagggggctgtgtgcacctccctaatggcagcgatgatggctgctgtcattcaagcccatcttcagacgtcacagtctggaagtgaaatgtccacaaacatctgtggcagaaaaggctatacggaccacccagttgtgctgcagctttacagagcaaggaagggttgtggcaaataaatgattaacctgcctcgactgtgctgagggcaacaaaggccatctcaccaaaggattattcgatgccattaaatcatcccgtgaccttcctgcttccgagtccatggcctttgcccagggcatgtactcccctgagaggccttctgcctagaaagatctatgactgggttccaaagttgaggcctaggtttttgctgggatttagatattttcaggcaccattttgacagcattcaggaaaacggttattgaccccatagactagggtaagaataaaggcaataaatttggtctgactcagaatataggagatccatatatttctctggaaaccacagtgtacactaaaatgtgaaattgaaggttttgttaaaaagaaaaagataatgagcttcatgctttgtttaattacataatgatttccattacgctatttctgtgaaatgcagcaggttcttaaacgttatttcagtggcatgggctggaagcttatcacaaaaagccatgtgtgtggccttatcagaacagaaagagacaggctggtgcccaaggctgctgcctgctccaccttttgccagctctggacatctgaggacgtcccggcagatctggaatggggccctcaactgaccatttgcttctcagaatttcagtttgagacatgagaggtataatcagttacttttctccccccagagaaacccttttgtgaggggagaggagctatggtatgtggttcagctgaaacacatacaactgcatccttttggagtcctttgccaacaaaaacagaccaacagaccagatggtgtccatgttcaatatcatgtcttgatggacgcagctgatgacctcaaatacttgagtggtctcatggctgttagatggattatttgaaaaaaaaaaaaaaaaaagagagaaaaaataattgatttttacatcagagatagcaaactaagacctggggaggggggtcagcttttattttattttattttttttaagtttgctagttgggtcaaatgtgaggaggagggagtctacctgccacctcttctcttgcccctcttctgcccacacatccagcatccaaaatccattcatttaatgaattgataaagtgccgtgcaaactggtgcacaaacaggcccccagtccacgcagcctggctcctaggaaaagtggtgaccgggcgtgggggggcatgccgcagccctgggacacagtcgggcaccttccccggacccccaggccttggctgtgcctcaagtcagagagggtcagccttcaggccccggagacgagtgactggccgatcatttcacaataaaatcactcacttttggcaacttcactttttttaaggcacagtcagttccttttctcatgtacctcacaaaagatgaagaccatgtagtactctttttggtaaagttacagtgttcatgttaaatatcacttttttctacattgtgtggtaaaaagaactacgttaatagctatatcttaaatactgtgatttgactttttgaaaaatatcctaatacaaatattttactaacttacaatcactcatttaataagaaacatttggattcttttgaaatcagtgttaattgactcatattcttaaaagcctggctcttgaccctattggaaacacaaaggaagctgaaatcaaacatctacagctcttcatttctcctgagccatgcagaatttactttcaatgtggaaatctgttccctttaccacactgtatatgcacagagcacaagagaggctatctctagtcacttccaccagcgaggccttaggactccgtattagaggccaccgatttcatacaacagtgtttcgctaaagacccttcactattcttgtttagtaaatagctgtctgctcttcagggaactgttacctatgggttattaccaaagaacgctggcaattggaaatgtcctgatggaaattctttgcacgtgccggttctctggcatcctccaggtggcccaacccaaagcagaaagcagaaaccacagaccccgtgagtctccccataccttgtttccaataacttggcaaaacttcttggtgcatattggttacaccctctgggattcataatgccattaggctaaaaccctaagagagagggttgacagaaacacacgcgagaatgaggcagatcccagagcaaggactgggcccagactctccacatgtgctctactagtgagtgccttatactctcagtattttggggcttacagcttcttatttgtgctaaaaaggtgcagttccaaagtaggaactgccacacaggccccagcatcctctctccaacttcatacctctctcctggtggggggagcgggcatccaggacctccggaatcaaggatgtgcagagaagagcgaaagtaatttttctagtcacatgaactgattggttccaggcaattagaaaatggctataaaataaccttaattttaaaaaaaaatcttgggtcttcgttttcctattaggagactgaactgaccacatgtattgatttatatcctgaatatatgggaacttctgtgtttgggatgtcctactgtaagactgatgaatgtacagagttaatttcagggtacagttttgccttaatggttttaaaaaataaactattttttaaaattt

SEQ ID NO: 437331 - DNA, 3686 bp, Homo sapiens
tcaaaggggcacgagggccagcaatggcagcagcagcggcgggcagtctgcccaagtgtcttaggaaccaaaagcaaataaaagtgtttccatatatgccaccagccaagtggccatcctaattcagaaagaagctagcctttgagtgtctgtcatggtgcatccgtttcagtattatttcctaaaatgagaagcccctgtgtcaacaagatccaggggctggagcccaatgccaagcctgtgttgtccccagcgaccctgcagctgctcgctctgatgtaccctgtgccattcaaggagatgtggtccaggaaagtgagcctcatggttttcagagaagtcattgttctgtttacattttcataaaacctgtttaaaatagctccccgtctcaggctttcagcagtaacagtgagctgactggcaagttcgatgttagctcccgggacactcagcagcgatggtgagcattttggtttccttaaggcccagcaagacttccagggacatctctggtgaagccagaatggagacacccgtgacctcaggctgaaagtcactcgacattggtctcttgtgttgatagggaaggaaatcaggcattcctatttctttaaataacaaaaccactaattgccactcaatgctggaatattttgggtcacctaatcatagatttctcagggcatcaatactcaaatataggctgattatgccccagttcaaatgggaactattaacagagtgcatttcttgcttgctgggtttcaacagacatcagccaaaagaacaaaagagatgtcaggacagattccaggagtgtcggagcacatgtgtggcacccgctccctctggcagcgaatgtaggaagtcgccaaatttacccactcttcaacaagtcattgtttaaacacggtttttcattttctcaacttttaatagcaaaaagtgccaaagtcctcagagacctaacagccttggtctaccgtgctgaccagggtgaaggcacggcgagggactcctcccagacgtgcctcttgtgtgccagctggctgtggctcgggagcagacgcaggcctctccattgtccaggggagcctggcggcgcatccctcctctcccacctcctggcacttccagctgggtgtcccacatgttggattccgtccccaccacacttccagagaccggagaactgtgcagggcctaaggccgtttggatgaattgtcaaaacaagatgcttccagttacagcggcaggagcgggactgggagcacgggctgacggctgctggtgcctttcttcccacctcgcttgcctgtttccgcttgacccttcctccagctccgatgagaagagtataaagcatcttcctaacgggtgtgtttgctatacgaacataatggacgtgaagtggggcagaaacccagaactcagcattcaaggatgcccaggagagctgtccctgttttaaagagctgtgttttgttttgtttcgcatttagagagcagacaaggcacccttctgctgcgctgatacgtttcttacactgggccattttagacccccagggaaacagccttcctggagcgttgtctggaggttccagggacagggcagcctcccagagccgagcaagagctcaaggtacaaatgagagatttgctataccgtgagaagtcaacaacttagccaccacttccccgcaatggaccatgtaacaaatacctcagcaggccctgcaaaaggccatgctagagctgaggcgcacagcctgtggcctctgtagttagggcaggtgggatggagactccttgagtgcacacacctgagcctgcccacacacaggggagcagcatctcgtatgacgtctggaaggaacttcggttgtgtaaagggagccttgaagatacgtgcaaaaggtgctaccccaatttggtgaaactgacattgggcacgtcttgggcttaggagaagcggccgatggtcccggcctgcagtgacaaacccccctccccgcaccgcccccagcaccccctctcctcttcacctcttcctgctggccacgaggaagccacttcctcagagagaccctaccagatgcggatggaaacagatgcaccaaagcaagccctgatgaaaccgcgacttcctaaggtctgtctcctctgaacttgcacctgggcctctctgtgtttggttccaagcacttcccacctcaaactcccattttcaaaccactgtatctctgcgcacatctgctacttaccagccgcatacatgatggagggttttttggtcctgatccagtggccacacctgtctttgaaatgtctcactgaactccagttttaaaatagattcattgcttcaacacagcaagcccaatgcacccagctaagactggcttgaccgacagcctggcctttggtggggggcttcctggggcctggggaaagctggccaccttcaacagctggtacctcttcaacagtgtggcctttcaaaatgcagatgccaccaggagaacatgcccacagctcaccacctatggatgccatggctctgggcagctttcaaagcaggttcctgtggtctcctcagctgtttgagggggtaacagcaaatcagcctccattttaaaatgaaaacaccagcctccagatgtagggcctgctgggtgttgctagccgctggtccccaggcacggtgcactttctccacctcctgcagcctccctgttgtttctagactcttgcacctggtgagtgcaaggataggtgacccaggggcctgcagccttgtcctcagctcccatctcctggactgccagcctcaccctctgcagttagcatggttggcctgatgcagggatcccgagggattactttttagaccttctttcacattcagaaaagtagtatagattcaggagaggcaagaaaattatgctgtccatagaagtcacccatgaagactgatgccaccacctgaaggctcatgattgttaaaaatgtccacgggaacctctcgtccacaggaggtttgtctcaacacttcccatttttacggcattggcattgccaagcatggggaagtatctgctcttctcatgttaaaagtggcccagcttttcttaactcagtccaagctgacttgtttagctgcactggaatttcttaccaaccaaatatttgcatcgagcaaagggggctgtgtgcacctccctaatggcagcgatgatggctgctgtcattcaagcccatcttcagacgtcacagtctggaagtgaaatgtccacaaacatctgtggcagaaaaggctatacggaccacccagttgtgctgcagctttacagagcaaggaagggttgtggcaaataaatgattaacctgcctcgactgtgctgagggcaacaaaggccatctcaccaaaggattattcgatgccattaaatcatcccgtgaccttcctgcttccgagtccatggcctttgcccagggcatgtactcccctgagaggccttctgcctagaaagatctatgactgggttccaaagttgaggcctaggtttttgctgggatttagatattttcaggcaccattttgacagcattcaggaaaacggttattgaccccatagactagggtaagaataaaggcaataaatttggtctgactcag

SEQ ID NO: 437332 - DNA, 761 bp, Homo sapiens
agcgggcgaacgaacgagccgagagggtggcggccgcctccctcctcccccggcctgaccgcagcccgacgccatggcgcgggtccccccgacgggccagtttcgattccgggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattggggtacgtggcctttccattttagctctgatcttagtgtttgtcatcagctctctcgctctctctttttacattttgttccgccaaaggggcaaaaagcaatagatgactacaaaatgaaattaagcactttgccttcaatctcctgtgaaatttgatggctgccttagaaactttggatcacattctcaccaatttaagtggatgtgttcatgaaaactctcctctaaggagactggatagctctttttcatatttctttgctttgcaatcagcttgtgttgctaacctaggccaaaaaaaaaaa

SEQ ID NO: 437333 - DNA, 521 bp, Homo sapiens
  misc_feature (479)..(479): n is a, c, g, or t
ctcgcgaacgtgttatccctcgcgtacgtcttatctctcgcgaacgtgttatctctcgcgaacgtgttatctctcgcgaacgtgttatctctcgcgaacgtgttatccctcgcgaacgtgttatcccaaccacctgtccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaatggtttgtaagcatctggaagaanccttctgatgcctgatacacgttcgcgaggaccggctgctca

SEQ ID NO: 437334 - DNA, 296 bp, Homo sapiens
atcaaggcctccttccttaggcaggtgtaaataaattaaacatttcttctaccgtaaataaaaagaaggcagaacaatcgaaactggggagacttggaaaacgctgaggccaaactttcgatattgatttattggggccgggagaatgaaaggttgggaagattctggggccttttgacatccttggttctttattactccggacttgattccttctcacttttttctgccattccactgaagagctgagagcccagggaagtcggagtgagcgatttcattacttttatgctaaa

SEQ ID NO: 437335 - DNA, 4153 bp, Homo sapiens
cgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgataatgaaggtgcgttgtatttgatacccctccccccctttttttggcaaaggaggggaaaggaaggtttaaaataattgatttaaaatgtcactaagtgtagactgatgactgtatagagatgtgaaatgtataattacacatggaagcaatatgttgctgtgttgttattaggttttttttgtttttgttttctacatcttttaaagacttttggaaatttggctgaacaattagaacacaacaggccaactcatactcatttggatctatttagacaacgttaaccaatatatctatagctttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgccattgtgccagaaacattgtgttatcttttatgttgttgttgttgctgttaaactataatatgtgacttctttttttattattttttgtttgaatgctttaaaaatcttttaagtctgtggatctgctgatgtacagtgcctttgctgctatggatcaaaatcaaaagaaccgtgtagatatactttattgtataagtagaaaattacttaatttcatactagaaatggatggatgctgcaagttgaaatggactgtccattgacgttcctaatgtggtagcagaaaaaaatggtgtcttaagtgcttagtgtttgatgtcattaacagtttcgtaaaactctacagtgtagaaagattttgatactaaactgtgcgttgtacatagttctaatgcattgtattgaccaccagtacttctataatggtagattgtttgtgaattcagacttttaagcattaaacataaataacttctagta

SEQ ID NO: 437336 - DNA, 4096 bp, Homo sapiens
cgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgagaagagggatatggggaaattgagtgaaacacgtcttagcgaagatgaacaatgcacattggggttacagagatggttttgtcgcctgtggtttatgaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgataatgaaggtgcgttgtatttgatacccctccccccctttttttggcaaaggaggggaaaggaaggtttaaaataattgatttaaaatgtcactaagtgtagactgatgactgtatagagatgtgaaatgtataattacacatggaagcaatatgttgctgtgttgttattaggttttttttgtttttgttttctacatcttttaaagacttttggaaatttggctgaacaattagaacacaacaggccaactcatactcatttggatctatttagacaacgttaaccaatatatctatagctttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgccattgtgccagaaacattgtgttatcttttatgttgttgttgttgctgttaaactataatatgtgacttctttttttattattttttgtttgaatgctttaaaaatcttttaagtctgtggatctgctgatgtacagtgcctttgctgctatggatcaaaatcaaaagaaccgtgtagatatactttattgtataagtagaaaattacttaatttcatactagaaatggatggatgctgcaagttgaaatggactgtccattgacgttcctaatgtggtagcagaaaaaaatggtgtcttaagtgcttagtgtttgatgtcattaacagtttcgtaaaactctacagtgtagaaagattttgatactaaactgtgcgttgtacatagttctaatgcattgtattgaccaccagtacttctataatggtagattgtttgtgaattcagacttttaagcattaaacataaataacttctagta

SEQ ID NO: 437337 - DNA, 4228 bp, Homo sapiens
cgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccgaccaaatgcttttaccacctgagggctttccctggaaatgaactggagatggaactgccaagagatactcacagagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgataatgaaggtgcgttgtatttgatacccctccccccctttttttggcaaaggaggggaaaggaaggtttaaaataattgatttaaaatgtcactaagtgtagactgatgactgtatagagatgtgaaatgtataattacacatggaagcaatatgttgctgtgttgttattaggttttttttgtttttgttttctacatcttttaaagacttttggaaatttggctgaacaattagaacacaacaggccaactcatactcatttggatctatttagacaacgttaaccaatatatctatagctttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgccattgtgccagaaacattgtgttatcttttatgttgttgttgttgctgttaaactataatatgtgacttctttttttattattttttgtttgaatgctttaaaaatcttttaagtctgtggatctgctgatgtacagtgcctttgctgctatggatcaaaatcaaaagaaccgtgtagatatactttattgtataagtagaaaattacttaatttcatactagaaatggatggatgctgcaagttgaaatggactgtccattgacgttcctaatgtggtagcagaaaaaaatggtgtcttaagtgcttagtgtttgatgtcattaacagtttcgtaaaactctacagtgtagaaagattttgatactaaactgtgcgttgtacatagttctaatgcattgtattgaccaccagtacttctataatggtagattgtttgtgaattcagacttttaagcattaaacataaataacttctagta

SEQ ID NO: 437338 - DNA, 4290 bp, Homo sapiens
cgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgataatgaaggtgcgttgtatttgatacccctccccccctttttttggcaaaggaggggaaaggaaggtttaaaataattgatttaaaatgtcactaagtgtagactgatgactgtatagagatgtgaaatgtataattacacatggaagcaatatgttgctgtgttgttattaggttttttttgtttttgttttctacatcttttaaagacttttggaaatttggctgaacaattagaacacaacaggccaactcatactcatttggatctatttagacaacgttaaccaatatatctatagctttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgccattgtgccagaaacattgtgttatcttttatgttgttgttgttgctgttaaactataatatgtgacttctttttttattattttttgtttgaatgctttaaaaatcttttaagtctgtggatctgctgatgtacagtgcctttgctgctatggatcaaaatcaaaagaaccgtgtagatatactttattgtataagtagaaaattacttaatttcatactagaaatggatggatgctgcaagttgaaatggactgtccattgacgttcctaatgtggtagcagaaaaaaatggtgtcttaagtgcttagtgtttgatgtcattaacagtttcgtaaaactctacagtgtagaaagattttgatactaaactgtgcgttgtacatagttctaatgcattgtattgaccaccagtacttctataatggtagattgtttgtgaattcagacttttaagcattaaacataaataacttctagtatgcttatttttctaattctttgtcttgatgacattagtttattttttatctttggctgtgccactcctatatattaaaaatgcctagttttttcaagggagattgttgttaaagtaaagtggttttttttgttgtta

SEQ ID NO: 437339 - DNA, 4193 bp, Homo sapiens
cgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgctgctgcctatgggagatcaccagtggtgggattgatccacaccatcacatgcgtgtgccagcagcacgacttcaccttccaatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgataatgaaggtgcgttgtatttgatacccctccccccctttttttggcaaaggaggggaaaggaaggtttaaaataattgatttaaaatgtcactaagtgtagactgatgactgtatagagatgtgaaatgtataattacacatggaagcaatatgttgctgtgttgttattaggttttttttgtttttgttttctacatcttttaaagacttttggaaatttggctgaacaattagaacacaacaggccaactcatactcatttggatctatttagacaacgttaaccaatatatctatagctttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgccattgtgccagaaacattgtgttatcttttatgttgttgttgttgctgttaaactataatatgtgacttctttttttattattttttgtttgaatgctttaaaaatcttttaagtctgtggatctgctgatgtacagtgcctttgctgctatggatcaaaatcaaaagaaccgtgtagatatactttattgtataagtagaaaattacttaatttcatactagaaatggatggatgctgcaagttgaaatggactgtccattgacgttcctaatgtggtagcagaaaaaaatggtgtcttaagtgcttagtgtttgatgtcattaacagtttcgtaaaactctacagtgtagaaagattttgatactaaactgtgcgttgtacatagttctaatgcattgtattgaccaccagtacttctataatggtagattgtttgtgaattcagacttttaagcattaaacataaataacttctagta

SEQ ID NO: 437340 - DNA, 4078 bp, Homo sapiens
cgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgataatgaaggtgcgttgtatttgatacccctccccccctttttttggcaaaggaggggaaaggaaggtttaaaataattgatttaaaatgtcactaagtgtagactgatgactgtatagagatgtgaaatgtataattacacatggaagcaatatgttgctgtgttgttattaggttttttttgtttttgttttctacatcttttaaagacttttggaaatttggctgaacaattagaacacaacaggccaactcatactcatttggatctatttagacaacgttaaccaatatatctatagctttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgccattgtgccagaaacattgtgttatcttttatgttgttgttgttgctgttaaactataatatgtgacttctttttttattattttttgtttgaatgctttaaaaatcttttaagtctgtggatctgctgatgtacagtgcctttgctgctatggatcaaaatcaaaagaaccgtgtagatatactttattgtataagtagaaaattacttaatttcatactagaaatggatggatgctgcaagttgaaatggactgtccattgacgttcctaatgtggtagcagaaaaaaatggtgtcttaagtgcttagtgtttgatgtcattaacagtttcgtaaaactctacagtgtagaaagattttgatactaaactgtgcgttgtacatagttctaatgcattgtattgaccaccagtacttctataatggtagattgtttgtgaattcagacttttaagcattaaacataaataacttctagta

SEQ ID NO: 437341 - DNA, 4108 bp, Homo sapiens
cgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgataatgaaggtgcgttgtatttgatacccctccccccctttttttggcaaaggaggggaaaggaaggtttaaaataattgatttaaaatgtcactaagtgtagactgatgactgtatagagatgtgaaatgtataattacacatggaagcaatatgttgctgtgttgttattaggttttttttgtttttgttttctacatcttttaaagacttttggaaatttggctgaacaattagaacacaacaggccaactcatactcatttggatctatttagacaacgttaaccaatatatctatagctttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgccattgtgccagaaacattgtgttatcttttatgttgttgttgttgctgttaaactataatatgtgacttctttttttattattttttgtttgaatgctttaaaaatcttttaagtctgtggatctgctgatgtacagtgcctttgctgctatggatcaaaatcaaaagaaccgtgtagatatactttattgtataagtagaaaattacttaatttcatactagaaatggatggatgctgcaagttgaaatggactgtccattgacgttcctaatgtggtagcagaaaaaaatggtgtcttaagtgcttagtgtttgatgtcattaacagtttcgtaaaactctacagtgtagaaagattttgatactaaactgtgcgttgtacatagttctaatgcattgtattgaccaccagtacttctataatggtagattgtttgtgaattcagacttttaagcattaaacataaataacttctagta

SEQ ID NO: 437342 - DNA, 4090 bp, Homo sapiens
cgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgataatgaaggtgcgttgtatttgatacccctccccccctttttttggcaaaggaggggaaaggaaggtttaaaataattgatttaaaatgtcactaagtgtagactgatgactgtatagagatgtgaaatgtataattacacatggaagcaatatgttgctgtgttgttattaggttttttttgtttttgttttctacatcttttaaagacttttggaaatttggctgaacaattagaacacaacaggccaactcatactcatttggatctatttagacaacgttaaccaatatatctatagctttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgccattgtgccagaaacattgtgttatcttttatgttgttgttgttgctgttaaactataatatgtgacttctttttttattattttttgtttgaatgctttaaaaatcttttaagtctgtggatctgctgatgtacagtgcctttgctgctatggatcaaaatcaaaagaaccgtgtagatatactttattgtataagtagaaaattacttaatttcatactagaaatggatggatgctgcaagttgaaatggactgtccattgacgttcctaatgtggtagcagaaaaaaatggtgtcttaagtgcttagtgtttgatgtcattaacagtttcgtaaaactctacagtgtagaaagattttgatactaaactgtgcgttgtacatagttctaatgcattgtattgaccaccagtacttctataatggtagattgtttgtgaattcagacttttaagcattaaacataaataacttctagta

SEQ ID NO: 437343 - DNA, 2231 bp, Homo sapiens
cgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaagagggatatggggaaattgagtgaaacacgtcttagcgaagatgaacaatgcacattggggttacagagatggttttgtcgcctgtggtttatggtaaatttagtttggggcttgaatgtgattttgttgctagctttgtttgaattaccaagctacatatgacggcaataattttcccttcctatctaaaaagtaatctctcatttacaaaagtctatcttgacttacatcacaaatcacaaatgcaaaaatgaactgctcacccatcaggataatctccctgcaccctattcttctgtggctgtgtagttaattgcaactttgtgtggtgtgtcttttttcctcaccagttatttccttgtaacataacatttaaaaaaagaataaaaagacaaattcagttttctaataacctctggaattcacagctaaaggaaaggaaattcctcacttggtctgcaaattaggggggataagtgcgacgggctagattgttggtgttgtttttttaaattttattttctcttggccttctggccttcttttaatggcacctgctctctgcttagtctctatgacaattcaagcttggatgtgttttctaatgtgacctgttcaccaggaagcctcttgtgacatgaacaatctgccaggagcccacagttaccccagtctttaccaaagtcaccagcaagtggccacagttaggacatcctggtttgtgagcctcatctgactcagaccaatttcctagaaatgagctgctctcctctaaattcagcttcagtttatgtcttcccaaatattaggtctgctgtctcaaggaactcttttgtttctttgttaacttttctattaaagaaaatcaaggcccaagctgaagaacctcttccatttcttttcctcctttccttttctttacctttttactgtttaacgtcattgttaaaaccatgttctaattgctggtatatgtcatttcatcttcagttgtctctgatgcagcttatacgaaataattgttgttctgttaactgaataccactctgtaattgc

SEQ ID NO: 437344 - DNA, 1145 bp, Homo sapiens
cgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctaggagcgtaatcggtccgagcct

SEQ ID NO: 437345 - DNA, 497 bp, Homo sapiens
gcggccgcctccctcctcccccggcctgaccgcagcccgacgccatggcgcgggtccccccgacgggccagtttcgattccgggtgaggagggagtgggcgcggcgcgcgggtccctgggtgcctgtctttggccggggaggggagacgggactcgaaccctcggggtccggggcgcgggggcctgcgggcgggagtatgcggggccccaggaccacctcgaaaccagcctctgcctgggctgttgggcgcgaggagggttgcgggaggagagttttaatctctctttgcttgcgtgcgcgatgaccctcaccccccgctaacgccgcatagtaggttttctccgtctccctgcttcgcctgtgatgtgggctaattaaatattttattgttgttcttcaggcaccgcatcagcctgctcaaccctttaaatttacaatttccgaatcctgtgatcggattaaggaagagtttcagtttttacaggctcaataccac

SEQ ID NO: 437346 - DNA, 1021 bp, Homo sapiens
agcgggcgaacgaacgagccgagagggtggcggccgcctccctcctcccccggcctgaccgcagcccgacgccatggcgcgggtccccccgacgggccagtttcgattccgggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccagcaaaactacttgctgctcataatggatgaaattggagaccaaagaggaagaaccttctgggttcctgtcagtctaaatcctgattttaaaagacattcacctgccatgctagtgttgtgtgcttctactggtaggaaaagctaataactaccctgacgagctcaacgagtggcccgaggactgtgatctcacagtttaccgtttttgcagagagcctcttttattttcgtgtcagattatctgtaaaatggacttctccctccagtgttgtaaaccataacaattctggcattcctctaattgtgtggggagagggagtatacccaacagatgcttgtcgagcaggaga

SEQ ID NO: 437347 - DNA, 536 bp, Homo sapiens
cgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatggtaagaaaaccatgtcacagattcaaagtgcctattagtttggaataccaaaaacaagaatatgtttaaattgctgggggctgcaagatagat

SEQ ID NO: 437348 - DNA, 4249 bp, Homo sapiens
cgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaagagggatatggggaaattgagtgaaacacgtcttagcgaagatgaacaatgcacattggggttacagagatggttttgtcgcctgtggtttatgaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgataatgaaggtgcgttgtatttgatacccctccccccctttttttggcaaaggaggggaaaggaaggtttaaaataattgatttaaaatgtcactaagtgtagactgatgactgtatagagatgtgaaatgtataattacacatggaagcaatatgttgctgtgttgttattaggttttttttgtttttgttttctacatcttttaaagacttttggaaatttggctgaacaattagaacacaacaggccaactcatactcatttggatctatttagacaacgttaaccaatatatctatagctttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgccattgtgccagaaacattgtgttatcttttatgttgttgttgttgctgttaaactataatatgtgacttctttttttattattttttgtttgaatgctttaaaaatcttttaagtctgtggatctgctgatgtacagtgcctttgctgctatggatcaaaatcaaaagaaccgtgtagatatactttattgtataagtagaaaattacttaatttcatactagaaatggatggatgctgcaagttgaaatggactgtccattgacgttcctaatgtggtagcagaaaaaaatggtgtcttaagtgcttagtgtttgatgtcattaacagtttcgtaaaactctacagtgtagaaagattttgatactaaactgtgcgttgtacatagttctaatgcattgtattgaccaccagtacttctataatggtagattgtttgtgaattcagacttttaagcattaaacataaataacttctagta

SEQ ID NO: 437349 - DNA, 5143 bp, Homo sapiens
cgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaagagggatatggggaaattgagtgaaacacgtcttagcgaagatgaacaatgcacattggggttacagagatggttttgtcgcctgtggtttatggtaaatttagtttggggcttgaatgtgattttgttgctagctttgtttgaattaccaagctacatatgacggcaataattttcccttcctatctaaaaagtaatctctcatttacaaaagtctatcttgacttacatcacaaatcacaaatgcaaaaatgaactgctcacccatcaggataatctccctgcaccctattcttctgtggctgtgtagttaattgcaactttgtgtggtgtgtcttttttcctcaccagttatttccttgtaacataacatttaaaaaaagaataaaaagacaaattcagttttctaataacctctggaattcacagctaaaggaaaggaaattcctcacttggtctgcaaattaggggggataagtgcgacgggctagattgttggtgttgtttttttaaattttattttctcttggccttctggccttcttttaatggcacctgctctctgcttagtctctatgacaattcaagcttggatgtgttttctaatgtgacctgttcaccaggaagcctcttgtgacatgaacaatctgccaggagcccacagttaccccagtctttaccaaagtcaccagcaagtggccacagttaggacatcctggtttgtgagcctcatctgactcagaccaatttcctagaaatgagctgctctcctctaaattcagcttcagtttatgtcttcccaaatattaggtctgctgtctcaaggaactcttttgtttctttgttaacttttctattaaagaaaatcaaggcccaagctgaagaacctcttccatttcttttcctcctttccttttctttacctttttactgtttaacgtcattgttaaaaccatgttctaattgctggtatatgtcatttcatcttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgataatgaaggtgcgttgtatttgatacccctccccccctttttttggcaaaggaggggaaaggaaggtttaaaataattgatttaaaatgtcactaagtgtagactgatgactgtatagagatgtgaaatgtataattacacatggaagcaatatgttgctgtgttgttattaggttttttttgtttttgttttctacatcttttaaagacttttggaaatttggctgaacaattagaacacaacaggccaactcatactcatttggatctatttagacaacgttaaccaatatatctatagctttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgccattgtgccagaaacattgtgttatcttttatgttgttgttgttgctgttaaactataatatgtgacttctttttttattattttttgtttgaatgctttaaaaatcttttaagtctgtggatctgctgatgtacagtgcctttgctgctatggatcaaaatcaaaagaaccgtgtagatatactttattgtataagtagaaaattacttaatttcatactagaaatggatggatgctgcaagttgaaatggactgtccattgacgttcctaatgtggtagcagaaaaaaatggtgtcttaagtgcttagtgtttgatgtcattaacagtttcgtaaaactctacagtgtagaaagattttgatactaaactgtgcgttgtacatagttctaatgcattgtattgaccaccagtacttctataatggtagattgtttgtgaattcagacttttaagcattaaacataaataacttctagta

SEQ ID NO: 437350 - DNA, 4192 bp, Homo sapiens
cgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattggggagaaaaagaataaaagtgacacacctggatcattaaagcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgataatgaaggtgcgttgtatttgatacccctccccccctttttttggcaaaggaggggaaaggaaggtttaaaataattgatttaaaatgtcactaagtgtagactgatgactgtatagagatgtgaaatgtataattacacatggaagcaatatgttgctgtgttgttattaggttttttttgtttttgttttctacatcttttaaagacttttggaaatttggctgaacaattagaacacaacaggccaactcatactcatttggatctatttagacaacgttaaccaatatatctatagctttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgccattgtgccagaaacattgtgttatcttttatgttgttgttgttgctgttaaactataatatgtgacttctttttttattattttttgtttgaatgctttaaaaatcttttaagtctgtggatctgctgatgtacagtgcctttgctgctatggatcaaaatcaaaagaaccgtgtagatatactttattgtataagtagaaaattacttaatttcatactagaaatggatggatgctgcaagttgaaatggactgtccattgacgttcctaatgtggtagcagaaaaaaatggtgtcttaagtgcttagtgtttgatgtcattaacagtttcgtaaaactctacagtgtagaaagattttgatactaaactgtgcgttgtacatagttctaatgcattgtattgaccaccagtacttctataatggtagattgtttgtgaattcagacttttaagcattaaacataaataacttctagta

SEQ ID NO: 437351 - DNA, 4041 bp, Homo sapiens
atcaaggcctccttccttaggcaggtgtaaataaattaaacatttcttctaccgtaaataaaaagaaggcagaacaatcgaaactggggagacttggaaaacgctgaggccaaactttcgatattgatttattggggccgggagaatgaaaggttgggaagattctggggccttttgacatccttggttctttattactccggacttgattccttctcacttttttctgccattccactgaagagctgagagcccagggaagtcggatctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgataatgaaggtgcgttgtatttgatacccctccccccctttttttggcaaaggaggggaaaggaaggtttaaaataattgatttaaaatgtcactaagtgtagactgatgactgtatagagatgtgaaatgtataattacacatggaagcaatatgttgctgtgttgttattaggttttttttgtttttgttttctacatcttttaaagacttttggaaatttggctgaacaattagaacacaacaggccaactcatactcatttggatctatttagacaacgttaaccaatatatctatagctttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgccattgtgccagaaacattgtgttatcttttatgttgttgttgttgctgttaaactataatatgtgacttctttttttattattttttgtttgaatgctttaaaaatcttttaagtctgtggatctgctgatgtacagtgcctttgctgctatggatcaaaatcaaaagaaccgtgtagatatactttattgtataagtagaaaattacttaatttcatactagaaatggatggatgctgcaagttgaaatggactgtccattgacgttcctaatgtggtagcagaaaaaaatggtgtcttaagtgcttagtgtttgatgtcattaacagtttcgtaaaactctacagtgtagaaagattttgatactaaactgtgcgttgtacatagttctaatgcattgtattgaccaccagtacttctataatggtagattgtttgtgaattcagacttttaagcattaaacataaataacttctagta

SEQ ID NO: 437352 - DNA, 4248 bp, Homo sapiens
cgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcagagactgtttttcacaaattgaaggctgtagcaaccctgaatggagctgttcttccaatagcctgtgctcacttcgtgtctctgtgtcacattttggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgataatgaaggtgcgttgtatttgatacccctccccccctttttttggcaaaggaggggaaaggaaggtttaaaataattgatttaaaatgtcactaagtgtagactgatgactgtatagagatgtgaaatgtataattacacatggaagcaatatgttgctgtgttgttattaggttttttttgtttttgttttctacatcttttaaagacttttggaaatttggctgaacaattagaacacaacaggccaactcatactcatttggatctatttagacaacgttaaccaatatatctatagctttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgccattgtgccagaaacattgtgttatcttttatgttgttgttgttgctgttaaactataatatgtgacttctttttttattattttttgtttgaatgctttaaaaatcttttaagtctgtggatctgctgatgtacagtgcctttgctgctatggatcaaaatcaaaagaaccgtgtagatatactttattgtataagtagaaaattacttaatttcatactagaaatggatggatgctgcaagttgaaatggactgtccattgacgttcctaatgtggtagcagaaaaaaatggtgtcttaagtgcttagtgtttgatgtcattaacagtttcgtaaaactctacagtgtagaaagattttgatactaaactgtgcgttgtacatagttctaatgcattgtattgaccaccagtacttctataatggtagattgtttgtgaattcagacttttaagcattaaacataaataacttctagta

SEQ ID NO: 437353 - DNA, 2910 bp, Homo sapiens
cgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattga

SEQ ID NO: 437354 - DNA, 1190 bp, Homo sapiens
cgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccagcaaaactacttgctgctcataatggatgaaattggagaccaaagaggaagaaccttctgggttcctgtcagtctaaatcctgattttaaaagacattcacctgccatgctagtgttgtgtgcttctactggtaggaaaagctaataactaccctgacgagctcaacgagtggcccgaggactgtgatctcacagtttaccgtttttgcagagagcctcttttattttcgtgtcagattatctgtaaaatggacttctccctccagtgttgtaaaccataacaattctggcattcctctaattgtgtggggagagggagtatacccaacagatgcttgtcgagcaggaga

SEQ ID NO: 437355 - DNA, 930 bp, Homo sapiens
cgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattggggtacgtggcctttccattttagctctgatcttagtgtttgtcatcagctctctcgctctctctttttacattttgttccgccaaaggggcaaaaagcaatagatgactacaaaatgaaattaagcactttgccttcaatctcctgtgaaatttgatggctgccttagaaactttggatcacattctcaccaatttaagtggatgtgttcatgaaaactctcctctaaggagactggatagctctttttcatatttctttgctttgcaatcagcttgtgttgctaacctaggccaaaaaaaaaaa

SEQ ID NO: 437356 - DNA, 3379 bp, Homo sapiens
ccacgtgcttgtgttgactggacaacttcctggtggaaaaccgcgactcttgcaagtgggcaaacttgacgttttcgctatgggcaaacgcgggagccggagccagagccagctactcaacaccctaactaaaaagcagaagaaacatcttcgagatttcggcgaggagcatcccttctatgacagggtttccagaaaggaagcaaagccacagatttgtcaactgtcagagagttcagattcttcagattctgaaagcgactcagagagtgaaccacaacaagtttctggctaccacagactacttgctacattaaagaatgtttctgaggaagaagaggaagatgaggaggaggaagaggaagaagacagtattgtagatgatgcagaaatgaacgatgaagatggtggtagcgatgtcagtgtggaagaagagatggctgcagagtctactgaaagtccagagaatgtagctttatctgctgaccctgagggaaaagaagatggggaagagccaccgggcacatcacaaacatcccccgaagagttcacagatgcaaaacacgagtcactgttcagcctggaaaccaattttctggaagaggaaagtggagacaactcttctttgaaagcctctcaagatccatttcttcaacatgtgaacaaagaactgaaagaaaaagcaattcaggctgttgccacaaatcccaaaactacccacgagcttaaatggcctattctgggccagcttttcttttcctctaagtttcagaagttggaaacatttaaacccccaaaggatattgacttaaagtcacttcatctccagaagcctctggaatccacctggactaagaccaacagccagttcctatctggtccccaaaaatcaagcagcccattcacccccctccagaaagaactcttcttaattatgaattcttaccgggacctgttctacccggaaaggactgctctgaagaacggggaagagatccgccatgtgtattgcctgcatgtgataaatcacatcctcaaagccaatgcccaggtgcttggcaacaatagcagacgccgaagccagaagtttggagtgggtgatgatgatgacttcagagaccaagggttaacaaggcccaaggtactgatagtggtgccattccgggaagctgctttgcgggtggtgcagctcttcatcagcctcctcgagggtgacagcaagaagaaaatcattgtgagcaacaaaaagaggtttcagggagaatatggatcagatcccgaggagagaccacccaacttgaagaggcctgaggattatgaagccgtatttgtgggcaatattgatgaccacttcaggattggagtggcaatacttcagagaagcatccgactctatgccccgttttactcctcggatatcctcattgcttcccccctgggcttgaggaccatcattggtggagaaggagagaagaagagagattttgactttctgtcttctatcgagcttctcatcattgatcaagctgacatttacctgatgcagaactgggagcatgtcctgcatttgatgaatcacatgaacctactacccctggactcacatggggtagacttttctcgagtgcggatgtggagcctcaataattggtccaagtactatcgccagacactgctatttggggcccttcaggatgcccagatcaactcagtgttcaacaagtactgtgtcaacatgcaaggccaggtggccgtgaggaatgtcccaatgacaggctctatcagtcatgtcctggtgcagctcccacatgtcttccagaggatggaagctgaaaacctagcttcagtgattgatgccaggtttaacttttttgtgaacaagattttgccacagtatcgtgatgcagtcatgtctcacacgctcatctatatcccctcctactttgacttcgtgcgtcttcgaaattacttcaagaaggaggaattgaattttacccacatctgcgagtacacgcagaagtctggtgtctccagggccagacacttcttccttcaaggagagaaacagtttctacttttcacagagcgcttccatttctacaaaaggtatacaataaaaggcatcaggaacctgattttctatgaactgccgacatatccacacttttacagtgaaatctgtaatatgctgagagccaccaacagaggagaagaggccacgtggacctgcactgttctctactccaaatatgatgcccagaggttagctgccgtggttggtgtggagcgggcggcacagatgctacagtccaacaagaatgtccacctcttcattactggagaaaaatgaaattttgttgggcaggaagtggtatttggcatgatacataatgtttgattctatgccatttggacccaattctgattacttacagaagaaggactgatacaaagaaagtgcatgaggcaatgtcagtattatctgacatctttcttttcaggtcatgtgtccctgaaaagttaaatgtaaaccagattttggtaaatcccatctttcagaagtgaagagggggctagaaggactctgagaagttggtagaagaaaactcccacttgtgaatatttttgtgagacataaattcttttattacgatttacctctaatttattacacttagtaaattcttccagatttttctatttgtttgacacttccttaaagtaaggaatacacattgcttgcgagaactggttatgagacattggaatacttcttgctgctacatgtcatcttaattttggatggcatgggttttgtaaaacttattctgccccagccaaacttttttgaaaccttaaatagtctaccttaattcagcctagaagagtacattgatttactgatcttttttcatattcataatactaaatgttttagttttgttcaaatatatgcttaaaatcacgttatttaaaaaacacatcagctctgtctcaagaagtaattttgttgaaactccatgttaaaatatccatcttcaacagtagtgtcttcataataactagtcattttttcagtcataaacagatgcaaataaaaaggaaattacacttttaaaaacatttttattttgaaacattctcaaacagaaaaattccaagtacagaacctgaaccatttgagagtgagttgccaacccagtgggcctatcacctttaaatactttagtatatatttcctgtaaacaattaagggtattgtttgtgattaggaatgccccaccaataaggataatgtgaatatttcagaatccaaaaaaattcgaaacacgtctggtcccaagcatttcagataagagatattcaactcatcctagta

SEQ ID NO: 437357 - DNA, 3231 bp, Homo sapiens
ccacgtgcttgtgttgactggacaacttcctggtggaaaaccgcgactcttgcaagtgggcaaacttgacgttttcgctatgggcaaacgcgggagccggagccagagccagctactcaacaccctaactaaaaagcagaagaaacatcttcgagatttcggcgaggagcatcccttctatgacagggtttccagaaaggaagcaaagccacagatttgtcaactgtcagagagttcagattcttcagattctgaaagcgactcagagagtgaaccacaacaagtttctggctaccacagactacttgctacattaaagaatgtttctgaggaagaagaggaagatgaggaggaggaagaggaagaagacagtattgtagatgatgcagaaatgaacgatgaagatggtggtagcgatgtcagtgtggaagaagagatggctgcagagtctactgaaagtccagagaatgtagctttatctgctgaccctgagggaaaagaagatggggaagagccaccgggcacatcacaaacatcccccgaagagttcacagatgcaaaacacgagtcactgttcagcctggaaaccaattttctggaagaggaaagtggagacaactcttctttgaaagcctctcaagatccatttcttcaacatgtgaacaaagaactgaaagaaaaagcaattcaggctgttgccacaaatcccaaaactacccacgagcttaaatggcctattctgggccagcttttcttttcctctaagtttcagaagttggaaacatttaaacccccaaaggatattgacttaaagtcacttcatctccagaagcctctggaatccacctggactaagaccaacagccagttcctatctggtccccaaaaatcaagcagcccattcacccccctccagaaagaactcttcttaattatgaattcttaccgggacctgttctacccggaaaggactgctctgaagaacggggaagagatccgccatgtgtattgcctgcatgtgataaatcacatcctcaaagccaatgcccaggtgcttggcaacaatagcagacgccgaagccagaagtttggagtgggtgatgatgatgacttcagagaccaagggttaacaaggcccaaggtactgatagtggtgccattccgggaagctgctttgcgggtggtgcagctcttcatcagcctcctcgagggtgacagcaagaagaaaatcattgtgagcaacaaaaagaggtttcagggagaatatggatcagatcccgaggagagaccacccaacttgaagaggcctgaggattatgaagccgtatttgtgggcaatattgatgaccacttcaggattggagtggcaatacttcagagaagcatccgactctatgccccgttttactcctcggatatcctcattgcttcccccctgggcttgaggaccatcattggtggagaaggagagaagaagagagattttgactttctgtcttctatcgagcttctcatcattgatcaagctgacatttacctgatgcagaactgggagcatgtcctgcatttgatgaatcacatgaacctactacccctggactcacatggggtagacttttctcgagtgcggatgtggagcctcaataattggtccaagtactatcgccagacactgctatttggggcccttcaggatgcccagatcaactcagtgttcaacaagtactgtgtcaacatgcaaggccaggtggccgtgaggaatgtcccaatgacaggctctatcagtcatgtcctggtgcagctcccacatgtcttccagaggatggaagctgaaaacctagcttcagtgattgatgccaggtttaacttttttgtgaacaagattttgccacagtatcgtgatgcagtcatgtctcacacgctcatctatatcccctcctactttgacttcgtgcgtcttcgaaattacttcaagaaggaggaattgaattttacccacatctgcgagtacacgcagaagtctggtgtctccagggccagacacttcttccttcaaggagagaaacagtttctacttttcacagagcgcttccatttctacaaaaggtatacaataaaaggcatcaggaacctgattttctatgaactgccgacatatccacacttttacagtgaaatctgtaatatgctgagagccaccaacagaggagaagaggccacgtggacctgcactgttctctactccaaatatgatgcccagaggttagctgccgtggttggtgtggagcgggcggcacagatgctacagtccaacaagaatgtccacctcttcattactggagaaaaatgaaattttgttgggcaggaagtggtatttggcatgatacataatgtttgattctatgccatttggacccaattctgattacttacagaagaaggactgatacaaagaaagtgcatgaggcaatgtcagtattatctgacatctttcttttcaggtcatgtgtccctgaaaagttaaatgtaaaccagattttggtaaatcccatctttcagaagtgaagagggggctagaaggactctgagaagttggtagaagaaaactcccacttgtgaatatttttgtgagacataaattcttttattacgatttacctctaatttattacacttagtaaattcttccagatttttctatttgtttgacacttccttaaagtaaggaatacacattgcttgcgagaactggttatgagacattggaatacttcttgctgctacatgtcatcttaattttggatggcatgggttttgtaaaacttattctgccccagccaaacttttttgaaaccttaaatagtctaccttaattcagcctagaagagtacattgatttactgatcttttttcatattcataatactaaatgttttagttttgttcaaatatatgaaattacacttttaaaaacatttttattttgaaacattctcaaacagaaaaattccaagtacagaacctgaaccatttgagagtgagttgccaacccagtgggcctatcacctttaaatactttagtatatatttcctgtaaacaattaagggtattgtttgtgattaggaatgccccaccaataaggataatgtgaatatttcagaatccaaaaaaattcgaaacacgtctggtcccaagcatttcagataagagatattcaactcatcctagta

SEQ ID NO: 437358 - DNA, 1671 bp, Homo sapiens
gtctgaccttgtctccattcttttttgcctgattataataaggctaatgttccattttaagtgcctgctttttaagttttctgtgacagatttttaaatcctggtctactattctttcccatgatacctcagcctacccagtgtaggatcaagaaatgtgtatttattttatcattttcttaagccaaatattaggaattcgaatatgttgtcataaaaagaattcaaatatgttgccacctcaagttagaataacttttgttctgttacttgtgccactgtttttctccattagcaggaagcaacaagcatgaactatgcctctgtacaactcctaggtagtttttctagaacttgtttctcaagttgacatagctctttctttccaattctgacaggtatacaataaaaggcatcaggaacctgattttctatgaactgccgacatatccacacttttacagtgaaatctgtaatatgctgagagccaccaacagaggagaagaggccacgtggacctgcactgttctctactccaaatatgatgcccagaggttagctgccgtggttggtgtggagcgggcggcacagatgctacagtccaacaagaatgtccacctcttcattactggagaaaaatgaaattttgttgggcaggaagtggtatttggcatgatacataatgtttgattctatgccatttggacccaattctgattacttacagaagaaggactgatacaaagaaagtgcatgaggcaatgtcagtattatctgacatctttcttttcaggtcatgtgtccctgaaaagttaaatgtaaaccagattttggtaaatcccatctttcagaagtgaagagggggctagaaggactctgagaagttggtagaagaaaactcccacttgtgaatatttttgtgagacataaattcttttattacgatttacctctaatttattacacttagtaaattcttccagatttttctatttgtttgacacttccttaaagtaaggaatacacattgcttgcgagaactggttatgagacattggaatacttcttgctgctacatgtcatcttaattttggatggcatgggttttgtaaaacttattctgccccagccaaacttttttgaaaccttaaatagtctaccttaattcagcctagaagagtacattgatttactgatcttttttcatattcataatactaaatgttttagttttgttcaaatatatgcttaaaatcacgttatttaaaaaacacatcagctctgtctcaagaagtaattttgttgaaactccatgttaaaatatccatcttcaacagtagtgtcttcataataactagtcattttttcagtcataaacagatgcaaataaaaaggaaattacacttttaaaaacatttttattttgaaacattctcaaacagaaaaattccaagtacagaacctgaaccatttgagagtgagttgccaacccagtgggcctatcacctttaaatactttagtatatatttcctgtaaacaattaagggtattgtttgtgattaggaatgccccaccaataaggataatgtgaatatttcagaatccaaaaaaattcgaaacacgtctggtcccaagcatttcagataagagatattcaactcatcctagta

SEQ ID NO: 437359 - DNA, 650 bp, Homo sapiens
catttgatgaatcacatgaacctactacccctggactcacatggggtagacttttctcgagtgcggatgtggagcctcaataattggtccaagtactatcgccagacactgctatttggggcccttcaggatgcccagatcaactcagtgttcaacaagtactgtgtcaacatgcaaggccaggtgggttctcgtcttgtttcctcagtatcttcatgagcactgtttattgtttgggtcctgaggtagaaggaggcgatagcttctggtcaagaaggggatggctgtccacctaacgctcttgttgactactggcaggtggccgtgaggaatgtcccaatgacaggctctatcagtcatgtcctggtgcagctcccacatgtcttccagaggatggaagctgaaaacctagcttcagtgattgatgccaggtaacccactcctcccagcaggcccctggggaccacatagagagatttgacttgggcatacaaacctagaattggattccattttgcttttattgataactaccaaatcagttgagataattgaacttaattatgtcatttgtcagaggaggaaactgaagcacagagagaaatagtgactttggcctaggtctcataactagttagtagcagggttat

SEQ ID NO: 437360 - DNA, 372 bp, Homo sapiens
acacctcttccctctacccccgcaccacctactatgtcccaacctaagacagttcctacctatcttgaaaattcgtaaaaagtgaacgcaattctgccaccctttccaaaactactatggcgcatccaaagctataagagtcttaaaaagccgacattaactgaaaatgaggtgagaggtatcctggccgagggcggggggcagcggggggtctccctccggacctacctcagggagctgagcgtgcaggcgctccagggcaggcctgggacagagtcaaggctcagagaataaaggtagctaatctcatcataatatttttattagaatgttctgatgataaaaataaaacttgttttctttaaagaaaaa

SEQ ID NO: 437361 - DNA, 259 bp, Homo sapiens
gcggccgcctactactactactactgctcgaattcaagcttctaacgatgtacgtgaggtgagaggtatcctggccgagggcggggggcagcggggggtctccctccggacctacctcagggagctgagcgtgcaggcgctccagggcaggcctgggacagagtcaaggctcagagaataaaggtagctaatctcatcataatatttttattagaatgttctgatgataaaaataaaacttgttttctttaaagaaaaa

SEQ ID NO: 437362 - DNA, 2181 bp, Homo sapiens
gcggcggatgcagtacaaccggcgctttgtcaacgttgtgcccacctttggcaagaagaaggacaccacgttcaccaagatcttcgtgggcggcctgccgtaccacactaccgacgcctcgctcaggaagtacttcgagggcttcggcgacatcgaggaggccgtggtcatcaccgaccgccagacgggcaagtcccgcggctacggcttcgtgaccatggccgaccgggcggcagctgagagggcttgcaaagacccgaaccccatcatcgacggccgcaaggccaacgtgaacctggcatatctgggcgccaagccgcggagcctccagacgggctttgccattggggtgcagcagctgcaccccaccttgatccagcggacttacgggctgaccccgcactacatctacccaccagccatcgtgcagcccagcgtggtgatcccagccgcccctgtcccgtcgctgtcctcgccctacattgagtacacgccggccagcccggcctacgcccagtacccaccggccacctatgaccagtacccatacgccgcctcgcctgccacggctgccagcttcgtgggctacagctaccctgccgccgtgccccaggccctctcagccgcagcacccgcgggcaccactttcgtgcagtaccaggcgccgcagctgcagcctgacaggatgcagtgaggggcgttcctgccccgaggactgtggcattgtcaccttcacagcagacagagctgccaggccatgatgggctggcgacagcccggctgagcttcagtgaggtgccaccagcacccgtgcctccgaagaccgctcgggcattccgcctgcgccctgggacagcggagagacggcttctctttaatctaggtcccattgtgtcttgagggaggactttaagaatgactgagaactatttaaagacgcaatcccaggttccttgcacaccatggcagcctctccttgcaccttctcctgcctctccacactccaggttccctcaggcttgtgtccccactgctgcatcgtggcggggtgtcacagaccctctgcagcccctggctgccctggactgtgcagagatgcctgactccagggaaacctgaaagcaagaagttaatggactgtttattgtaacttgatcctcccgagctgtgagcgcagtctgaggtgtgaggacacggcctcctgttggagtcccattttctccatcagggcacgtgggcggcttcctcaagcccggaggagctcccaggcgcacaggggccgccggtaacaggggccgccggccaaaggcccctttccagtcatagcactgaagttgcaacttttttcttgtaattgttttgctactaagataatttcagaagttcagtctattttttcagcggatactgccgccaccaagaatccaaaacctatttttgacttggagagacttgcttttgttggttccgcccgtggagacgacgatagtgtttctgtataataaagtgtctgccggctcgcgggccaggatcctctcggtgggatgggcaccacagacaggaggcccctcaggcccgtgcgggccactgtctgctgccgcctgccggggtggcagagtgagttgtctcaggaccccgtcactgcgacgttgacactcctctcccttcccttcctccccaactccccaaacactgtggaaggggagaaggaagtgatccacagcattcaggccacttggggtctagaccatggtggtgccagcctggggggggcagtggccctcagctctgcccgctggagcggttgagtgcagaagggtgcgcctcttccctctacccccgcaccacctgctgtgtgccagcctgagacggttcctgcctgtcttgggggttggtggagggtggaggcagttctgccagccgtggcagggctgctatggggcatccagggctgtgggggtctggaggaggggacatgaggtgagaggtatcctggccgagggcggggggcagcggggggtctccctccggacctacctcagggagctgagcgtgcaggcgctccagggcaggcctgggacagagtcaaggctcagagaataaaggtagctaatctcatcataatatttttattagaatgttctgatgataaaaataaaacttgttttctttaaagaaaaa

SEQ ID NO: 437363 - DNA, 2048 bp, Homo sapiens
gaatcgagctcggtaccagcagggggtgccgtggtcatcaccgaccgccagacgggcaagtcccgcggctacggcttcgtgaccatggccgaccgggcggcagctgagagggcttgcaaagacccgaaccccatcatcgacggccgcaaggccaacgtgaacctggcatatctgggcgccaagccgcggagcctccagacgggctttgccattggggtgcagcagctgcaccccaccttgatccagcggacttacgggctgaccccgcactacatctacccaccagccatcgtgcagcccagcgtggtgatcccagccgcccctgtcccgtcgctgtcctcgccctacattgagtacacgccggccagcccggcctacgcccagtacccaccggccacctatgaccagtacccatacgccgcctcgcctgccacggctgccagcttcgtgggctacagctaccctgccgccgtgccccaggccctctcagccgcagcacccgcgggcaccactttcgtgcagtaccaggcgccgcagctgcagcctgacaggatgcagtgaggggcgttcctgccccgaggactgtggcattgtcaccttcacagcagacagagctgccaggccatgatgggctggcgacagcccggctgagcttcagtgaggtgccaccagcacccgtgcctccgaagaccgctcgggcattccgcctgcgccctgggacagcggagagacggcttctctttaatctaggtcccattgtgtcttgagggaggactttaagaatgactgagaactatttaaagacgcaatcccaggttccttgcacaccatggcagcctctccttgcaccttctcctgcctctccacactccaggttccctcaggcttgtgtccccactgctgcatcgtggcggggtgtcacagaccctctgcagcccctggctgccctggactgtgcagagatgcctgactccagggaaacctgaaagcaagaagttaatggactgtttattgtaacttgatcctcccgagctgtgagcgcagtctgaggtgtgaggacacggcctcctgttggagtcccattttctccatcagggcacgtgggcggcttcctcaagcccggaggagctcccaggcgcacaggggccgccggtaacaggggccgccggccaaaggcccctttccagtcatagcactgaagttgcaacttttttcttgtaattgttttgctactaagataatttcagaagttcagtctattttttcagcggatactgccgccaccaagaatccaaaacctatttttgacttggagagacttgcttttgttggttccgcccgtggagacgacgatagtgtttctgtataataaagtgtctgccggctcgcgggccaggatcctctcggtgggatgggcaccacagacaggaggcccctcaggcccgtgcgggccactgtctgctgccgcctgccggggtggcagagtgagttgtctcaggaccccgtcactgcgacgttgacactcctctcccttcccttcctccccaactccccaaacactgtggaaggggagaaggaagtgatccacagcattcaggccacttggggtctagaccatggtggtgccagcctggggggggcagtggccctcagctctgcccgctggagcggttgagtgcagaagggtgcgcctcttccctctacccccgcaccacctgctgtgtgccagcctgagacggttcctgcctgtcttgggggttggtggagggtggaggcagttctgccagccgtggcagggctgctatggggcatccagggctgtgggggtctggaggaggggacatgaggtgagaggtatcctggccgagggcggggggcagcggggggtctccctccggacctacctcagggagctgagcgtgcaggcgctccagggcaggcctgggacagagtcaaggctcagagaataaaggtagctaatctcatcataatatttttattagaatgttctgatgataaaaataaaacttgttttctttaaagaaaaa

SEQ ID NO: 437364 - DNA, 2234 bp, Homo sapiens
aataaacatcagcttaagtaaaaacgtcttgaagacactttcctgcttaccttccaagcatagcgtcgcaaactccttctcagaggaaagtctcggccctcactggtgggcaagtccaggcggccccccaagctcccttcggggttcatttttgccctatccccgcaggggattatttttgtccttgaaggccacatttcccaggccttgaactttgacgggaggagctggaatccaggaggcatctttgtgggagagccccaggtgaccatggccgaccgggcggcagctgagagggcttgcaaagacccgaaccccatcatcgacggccgcaaggccaacgtgaacctggcatatctgggcgccaagccgcggagcctccagacgggctttgccattggggtgcagcagctgcaccccaccttgatccagcggacttacgggctgaccccgcactacatctacccaccagccatcgtgcagcccagcgtggtgatcccagccgcccctgtcccgtcgctgtcctcgccctacattgagtacacgccggccagcccggcctacgcccagtacccaccggccacctatgaccagtacccatacgccgcctcgcctgccacggctgccagcttcgtgggctacagctaccctgccgccgtgccccaggccctctcagccgcagcacccgcgggcaccactttcgtgcagtaccaggcgccgcagctgcagcctgacaggatgcagtgaggggcgttcctgccccgaggactgtggcattgtcaccttcacagcagacagagctgccaggccatgatgggctggcgacagcccggctgagcttcagtgaggtgccaccagcacccgtgcctccgaagaccgctcgggcattccgcctgcgccctgggacagcggagagacggcttctctttaatctaggtcccattgtgtcttgagggaggactttaagaatgactgagaactatttaaagacgcaatcccaggttccttgcacaccatggcagcctctccttgcaccttctcctgcctctccacactccaggttccctcaggcttgtgtccccactgctgcatcgtggcggggtgtcacagaccctctgcagcccctggctgccctggactgtgcagagatgcctgactccagggaaacctgaaagcaagaagttaatggactgtttattgtaacttgatcctcccgagctgtgagcgcagtctgaggtgtgaggacacggcctcctgttggagtcccattttctccatcagggcacgtgggcggcttcctcaagcccggaggagctcccaggcgcacaggggccgccggtaacaggggccgccggccaaaggcccctttccagtcatagcactgaagttgcaacttttttcttgtaattgttttgctactaagataatttcagaagttcagtctattttttcagcggatactgccgccaccaagaatccaaaacctatttttgacttggagagacttgcttttgttggttccgcccgtggagacgacgatagtgtttctgtataataaagtgtctgccggctcgcgggccaggatcctctcggtgggatgggcaccacagacaggaggcccctcaggcccgtgcgggccactgtctgctgccgcctgccggggtggcagagtgagttgtctcaggaccccgtcactgcgacgttgacactcctctcccttcccttcctccccaactccccaaacactgtggaaggggagaaggaagtgatccacagcattcaggccacttggggtctagaccatggtggtgccagcctggggggggcagtggccctcagctctgcccgctggagcggttgagtgcagaagggtgcgcctcttccctctacccccgcaccacctgctgtgtgccagcctgagacggttcctgcctgtcttgggggttggtggagggtggaggcagttctgccagccgtggcagggctgctatggggcatccagggctgtgggggtctggaggaggggacatgaggtgagaggtatcctggccgagggcggggggcagcggggggtctccctccggacctacctcagggagctgagcgtgcaggcgctccagggcaggcctgggacagagtcaaggctcagagaataaaggtagctaatctcatcataatatttttattagaatgttctgatgataaaaataaaacttgttttctttaaagaaaaa

SEQ ID NO: 437365 - DNA, 2169 bp, Homo sapiens
gaatcgagctcggtaccagcagggggtgccgtggtcatcaccgaccgccagacgggcaagtcccgcggctacggcttcgtgaccatggccgaccgggcggcagctgagagggcttgcaaagacccgaaccccatcatcgacggccgcaaggccaacgtgaacctggcatatctgggcgccaagccgcggagcctccagacgggctttgccattggggtgcagcagctgcaccccaccttgatccagcggacttacggctgtaggaccttgggcaactcacctggccccgtgtgtgaaatgggcctcatgatgggaagaccaagccgacggggtgacgcacccagtcacagtacgggtctccccccagcgtgggcgctggctgaccccgcactacatctacccaccagccatcgtgcagcccagcgtggtgatcccagccgcccctgtcccgtcgctgtcctcgccctacattgagtacacgccggccagcccggcctacgcccagtacccaccggccacctatgaccagtacccatacgccgcctcgcctgccacggctgccagcttcgtgggctacagctaccctgccgccgtgccccaggccctctcagccgcagcacccgcgggcaccactttcgtgcagtaccaggcgccgcagctgcagcctgacaggatgcagtgaggggcgttcctgccccgaggactgtggcattgtcaccttcacagcagacagagctgccaggccatgatgggctggcgacagcccggctgagcttcagtgaggtgccaccagcacccgtgcctccgaagaccgctcgggcattccgcctgcgccctgggacagcggagagacggcttctctttaatctaggtcccattgtgtcttgagggaggactttaagaatgactgagaactatttaaagacgcaatcccaggttccttgcacaccatggcagcctctccttgcaccttctcctgcctctccacactccaggttccctcaggcttgtgtccccactgctgcatcgtggcggggtgtcacagaccctctgcagcccctggctgccctggactgtgcagagatgcctgactccagggaaacctgaaagcaagaagttaatggactgtttattgtaacttgatcctcccgagctgtgagcgcagtctgaggtgtgaggacacggcctcctgttggagtcccattttctccatcagggcacgtgggcggcttcctcaagcccggaggagctcccaggcgcacaggggccgccggtaacaggggccgccggccaaaggcccctttccagtcatagcactgaagttgcaacttttttcttgtaattgttttgctactaagataatttcagaagttcagtctattttttcagcggatactgccgccaccaagaatccaaaacctatttttgacttggagagacttgcttttgttggttccgcccgtggagacgacgatagtgtttctgtataataaagtgtctgccggctcgcgggccaggatcctctcggtgggatgggcaccacagacaggaggcccctcaggcccgtgcgggccactgtctgctgccgcctgccggggtggcagagtgagttgtctcaggaccccgtcactgcgacgttgacactcctctcccttcccttcctccccaactccccaaacactgtggaaggggagaaggaagtgatccacagcattcaggccacttggggtctagaccatggtggtgccagcctggggggggcagtggccctcagctctgcccgctggagcggttgagtgcagaagggtgcgcctcttccctctacccccgcaccacctgctgtgtgccagcctgagacggttcctgcctgtcttgggggttggtggagggtggaggcagttctgccagccgtggcagggctgctatggggcatccagggctgtgggggtctggaggaggggacatgaggtgagaggtatcctggccgagggcggggggcagcggggggtctccctccggacctacctcagggagctgagcgtgcaggcgctccagggcaggcctgggacagagtcaaggctcagagaataaaggtagctaatctcatcataatatttttattagaatgttctgatgataaaaataaaacttgttttctttaaagaaaaa

SEQ ID NO: 437366 - DNA, 1681 bp, Homo sapiens
  misc_feature (1)..(1): n is a, c, g, or t
ngatacaatcgagctcggtaccaggaaacagctatgaccagtacccatacgccgcctcgcctgccacggctgccagcttcgtgggctacagctaccctgccgccgtgccccaggccctctcagccgcagcacccgcgggcaccactttcgtgcagtaccaggcgccgcagctgcagcctgacaggatgcagtgaggggcgttcctgccccgaggactgtggcattgtcaccttcacagcagacagagctgccaggccatgatgggctggcgacagcccggctgagcttcagtgaggtgccaccagcacccgtgcctccgaagaccgctcgggcattccgcctgcgccctgggacagcggagagacggcttctctttaatctaggtcccattgtgtcttgagggaggactttaagaatgactgagaactatttaaagacgcaatcccaggttccttgcacaccatggcagcctctccttgcaccttctcctgcctctccacactccaggttccctcaggcttgtgtccccactgctgcatcgtggcggggtgtcacagaccctctgcagcccctggctgccctggactgtgcagagatgcctgactccagggaaacctgaaagcaagaagttaatggactgtttattgtaacttgatcctcccgagctgtgagcgcagtctgaggtgtgaggacacggcctcctgttggagtcccattttctccatcagggcacgtgggcggcttcctcaagcccggaggagctcccaggcgcacaggggccgccggtaacaggggccgccggccaaaggcccctttccagtcatagcactgaagttgcaacttttttcttgtaattgttttgctactaagataatttcagaagttcagtctattttttcagcggatactgccgccaccaagaatccaaaacctatttttgacttggagagacttgcttttgttggttccgcccgtggagacgacgatagtgtttctgtataataaagtgtctgccggctcgcgggccaggatcctctcggtgggatgggcaccacagacaggaggcccctcaggcccgtgcgggccactgtctgctgccgcctgccggggtggcagagtgagttgtctcaggaccccgtcactgcgacgttgacactcctctcccttcccttcctccccaactccccaaacactgtggaaggggagaaggaagtgatccacagcattcaggccacttggggtctagaccatggtggtgccagcctggggggggcagtggccctcagctctgcccgctggagcggttgagtgcagaagggtgcgcctcttccctctacccccgcaccacctgctgtgtgccagcctgagacggttcctgcctgtcttgggggttggtggagggtggaggcagttctgccagccgtggcagggctgctatggggcatccagggctgtgggggtctggaggaggggacatgaggtgagaggtatcctggccgagggcggggggcagcggggggtctccctccggacctacctcagggagctgagcgtgcaggcgctccagggcaggcctgggacagagtcaaggctcagagaataaaggtagctaatctcatcataatatttttattagaatgttctgatgataaaaataaaacttgttttctttaaagaaaaa

SEQ ID NO: 437367 - DNA, 2836 bp, Homo sapiens
gcgcagcgcggcgcactcggcgcgcacggcgggagcggcgcgcgagtggtcgggcctggcggctggacgggcgcccctcgctgccccgcgcgctccccgccgccccccatgagcgcaccccgcgcggcccgggtccgtaggcggcggggcgccccccatgctgctgcagcccgcgccgtgcgccccgagcgcgggcttcccgcggcccctggccgcccccggcgccatgcacggctcgcagaaggacaccacgttcaccaagatcttcgtgggcggcctgccgtaccacactaccgacgcctcgctcaggaagtacttcgagggcttcggcgacatcgaggaggccgtggtcatcaccgaccgccagacgggcaagtcccgcggctacggcttcgtgaccatggccgaccgggcggcagctgagagggcttgcaaagacccgaaccccatcatcgacggccgcaaggccaacgtgaacctggcatatctgggcgccaagccgcggagcctccagacgggctttgccattggggtgcagcagctgcaccccaccttgatccagcggacttacgggctgaccccgcactacatctacccaccagccatcgtgcagcccagcgtggtgatcccagccgcccctgtcccgtcgctgtcctcgccctacattgagtacacgccggccagcccggcctacgcccagtacccaccggccacctatgaccagtacccatacgccgcctcgcctgccacggctgccagcttcgtgggctacagctaccctgccgccgtgccccaggccctctcagccgcagcacccgcgggcaccactttcgtgcagtaccaggcgccgcagctgcagcctgacaggatgcagtgaggggcgttcctgccccgaggactgtggcattgtcaccttcacagcagacagagctgccaggccatgatgggctggcgacagcccggctgagcttcagtgaggtgccaccagcacccgtgcctccgaagaccgctcgggcattccgcctgcgccctgggacagcggagagacggcttctctttaatctaggtcccattgtgtcttgagggaggactttaagaatgactgagaactatttaaagacgcaatcccaggttccttgcacaccatggcagcctctccttgcaccttctcctgcctctccacactccaggttccctcaggcttgtgtccccactgctgcatcgtggcggggtgtcacagaccctctgcagcccctggctgccctggactgtgcagagatgcctgactccagggaaacctgaaagcaagaagttaatggactgtttattgtaacttgatcctcccgagctgtgagcgcagtctgaggtgtgaggacacggcctcctgttggagtcccattttctccatcagggcacgtgggcggcttcctcaagcccggaggagctcccaggcgcacaggggccgccggtaacaggggccgccggccaaaggcccctttccagtcatagcactgaagttgcaacttttttcttgtaattgttttgctactaagataatttcagaagttcagtctattttttcagcggatactgccgccaccaagaatccaaaacctatttttgacttggagagacttgcttttgttggttccgcccgtggagacgacgatagtgtttctgtataataaagtgtctgccggctcgcgggccaggatcctctcggtgggatgggcaccacagacaggaggcccctcaggcccgtgcgggccactgtctgctgccgcctgccggggtggcagagtgagttgtctcaggaccccgtcactgcgacgttgacactcctctcccttcccttcctccccaactccccaaacactgtggaaggggagaaggaagtgatccacagcattcaggccacttggggtctagaccatggtggtgccagcctggggggggcagtggccctcagctctgcccgctggagcggttgagtgcagaagggtgcgcctcttccctctacccccgcaccacctgctgtgtgccagcctgagacggttcctgcctgtcttgggggttggtggagggtggaggcagttctgccagccgtggcagggctgctatggggcatccagggctgtgggggtctggaggaggggacatgaggtgagaggtatcctggccgagggcggggggcagcggggggtctccctccggacctacctcagggagctgagcgtgcaggcgctccagggcaggcctgggacagagtcaaggctcagagaataaaggtagctaatctcatcataatatttttattagaatgttctgatgataaaaataaaacttgttttctttaaagaaaaaaaaaaaaaaaaaaaaaaaaaaaaaaaaaaaaaaaaaaaaaaaaaaaaaaaaaaaaaaagggggggggcccccaagtaaaggacctcccccgtagggggggcacccaatagtggagggagcgcccccgagcttgttggttgcaagagggggccccacccaagaggaggagtcgactaaattacaccacgagagccgggcggcgggggtttaaacaaaacaacgatgggtgcgtgggagaaaaactggtcgatccagggggagagtctttcgggaaggaggccccacaccatctggggggggggggcgaacaactaggtggggagacccccacccctcccagagtgatctatacgccctcggggggaaataataactatgaggggtcatgtgggtgcaaacacaccgggcaacagtgcgggcgagaaaaatgtcgacgggagatgtgattaagaaatttttcgggcggggagaa

SEQ ID NO: 437368 - DNA, 1422 bp, Homo sapiens
  misc_feature (1359)..(1360): n is a, c, g, or t
gcgcagcgcggcgcactcggcgcgcacggcgggagcggcgcgcgagtggtcgggcctggcggctggacgggcgcccctcgctgccccgcgcgctccccgccgccccccatgagcgcaccccgcgcggcccgggtccgtaggcggcggggcgccccccatgctgctgcagcccgcgccgtgcgccccgagcgcgggcttcccgcggcccctggccgcccccggcgccatgcacggctcgcagaaggacaccacgttcaccaagatcttcgtgggcggcctgccgtaccacactaccgacgcctcgctcaggaagtacttcgagggcttcggcgacatcgaggaggccgtggtcatcaccgaccgccagacgggcaagtcccgcggctacggcttcgtgaccatggccgaccgggcggcagctgagagggcttgcaaagacccgaaccccatcatcgacggccgcaaggccaacgtgaacctggcatatctgggcgccaagccgcggagcctccagacgggctttgccattggggtgcagcagctgcaccccaccttgatccagcggacttacgggctgaccccgcactacatctacccaccagccatcgtgcagcccagcgtggtgatcccagccgcccctgtcccgtcgctgtcctcgccctacattgagtacacgccggccagcccggcctacgcccagtacccaccggccacctatgaccagtacccatacgccgcctcgcctgccacggctgccagcttcgtgggctacagctaccctgccgccgtgccccaggccctctcagccgcagcacccgcgggcaccactttcgtgcagtaccaggcgccgcagctgcagcctgacaggatgcagtgaggggcgttcctgccccgaggactgtggcattgtcaccttcacagcagacagagctgccaggccatgatgggctggcgacagcccggctgagcttcagtgaggtgccaccagcacccgtgcctccgaagaccgctcgggcattccgcctgcgccctgggacagcggagagacggcttctctttaatctaggtcccattgtgtcttgagggaggactttaagaatgactgagaactatttaaagacgcaatcccaggttccttgcacaccatggcagcctctccttgcaccttctcctgcctctccacactccaggttccctcaggcttgtgtccccactgctgcatcgtggcggggtgtcacagaccctctgcagcccctggctgccctggactgtgcagagatgcctgactccagggaaacctgaaagcaagaagttaatggactgtttattgtaacttgatcctcccgagctgtgacacgnngaagtggagaacagccccggtgagaacccatatccaagggacggagaggaaacacaccgaga

SEQ ID NO: 437369 - DNA, 368 bp, Homo sapiens
gaatcgagctcggtaccagcagggggtgccgtggtcatcaccgaccgccagacgggcaagtcccgcggctacggcttcgtgaccatggccgaccgggcggcagctgagagggcttgcaaagacccgaaccccatcatcgacggccgcaaggccaacgtgaacctggcatatctgggcgacagaccagcggacaacgtctcagacgcctgcagcagaggtggtagagcatctgcaacacaccaagattcaaacggagtcaggtacaacggacgcacaaaatgtaggcaccatcgattcagaaagacaaagtgtggaacccagcagctcctatcgcactgctcacactctgcggagcatggagtaacaca

SEQ ID NO: 437370 - DNA, 2364 bp, Homo sapiens
gcgcagcgcggcgcactcggcgcgcacggcgggagcggcgcgcgagtggtcgggcctggcggctggacgggcgcccctcgctgccccgcgcgctccccgccgccccccatgagcgcaccccgcgcggcccgggtccgtaggcggcggggcgccccccatgctgctgcagcccgcgccgtgcgccccgagcgcgggcttcccgcggcccctggccgcccccggcgccatgcacggctcgcagaaggacaccacgttcaccaagatcttcgtgggcggcctgccgtaccacactaccgacgcctcgctcaggaagtacttcgagggcttcggcgacatcgaggaggccgtggtcatcaccgaccgccagacgggcaagtcccgcggctacggcttcgtgaccatggccgaccgggcggcagctgagagggcttgcaaagacccgaaccccatcatcgacggccgcaaggccaacgtgaacctggcatatctgggcgccaagccgcggagcctccagacgggctttgccattggggtgcagcagctgcaccccaccttgatccagcggacttacgggctgaccccgcactacatctacccaccagccatcgtgcagcccagcgtggtgatcccagccgcccctgtcccgtcgctgtcctcgccctacattgagtacacgccggccagcccggcctacgcccagtacccaccggccacctatgaccagtacccatacgccgcctcgcctgccacggctgccagcttcgtgggctacagctaccctgccgccgtgccccaggccctctcagccgcagcacccgcgggcaccactttcgtgcagtaccaggcgccgcagctgcagcctgacaggatgcagtgaggggcgttcctgccccgaggactgtggcattgtcaccttcacagcagacagagctgccaggccatgatgggctggcgacagcccggctgagcttcagtgaggtgccaccagcacccgtgcctccgaagaccgctcgggcattccgcctgcgccctgggacagcggagagacggcttctctttaatctaggtcccattgtgtcttgagggaggactttaagaatgactgagaactatttaaagacgcaatcccaggttccttgcacaccatggcagcctctccttgcaccttctcctgcctctccacactccaggttccctcaggcttgtgtccccactgctgcatcgtggcggggtgtcacagaccctctgcagcccctggctgccctggactgtgcagagatgcctgactccagggaaacctgaaagcaagaagttaatggactgtttattgtaacttgatcctcccgagctgtgagcgcagtctgaggtgtgaggacacggcctcctgttggagtcccattttctccatcagggcacgtgggcggcttcctcaagcccggaggagctcccaggcgcacaggggccgccggtaacaggggccgccggccaaaggcccctttccagtcatagcactgaagttgcaacttttttcttgtaattgttttgctactaagataatttcagaagttcagtctattttttcagcggatactgccgccaccaagaatccaaaacctatttttgacttggagagacttgcttttgttggttccgcccgtggagacgacgatagtgtttctgtataataaagtgtctgccggctcgcgggccaggatcctctcggtgggatgggcaccacagacaggaggcccctcaggcccgtgcgggccactgtctgctgccgcctgccggggtggcagagtgagttgtctcaggaccccgtcactgcgacgttgacactcctctcccttcccttcctccccaactccccaaacactgtggaaggggagaaggaagtgatccacagcattcaggccacttggggtctagaccatggtggtgccagcctggggggggcagtggccctcagctctgcccgctggagcggttgagtgcagaagggtgcgcctcttccctctacccccgcaccacctgctgtgtgccagcctgagacggttcctgcctgtcttgggggttggtggagggtggaggcagttctgccagccgtggcagggctgctatggggcatccagggctgtgggggtctggaggaggggacatgaggtgagaggtatcctggccgagggcggggggcagcggggggtctccctccggacctacctcagggagctgagcgtgcaggcgctccagggcaggcctgggacagagtcaaggctcagagaataaaggtagctaatctcatcataatatttttattagaatgttctgatgataaaaataaaacttgttttctttaaagaaaaa

SEQ ID NO: 437371 - DNA, 2437 bp, Homo sapiens
gcgcagcgcggcgcactcggcgcgcacggcgggagcggcgcgcgagtggtcgggcctggcggctggacgggcgcccctcgctgccccgcgcgctccccgccgccccccatgagcgcaccccgcgcggcccgggtccgtaggcggcggggcgccccccatgctgctgcagcccgcgccgtgcgccccgagcgcgggcttcccgcggcccctggccgcccccggcgccatgcacggctcgcagaaggacaccacgttcaccaagatcttcgtgggcggcctgccgtaccacactaccgacgcctcgctcaggaagtacttcgagggcttcggcgacatcgaggaggccgtggtcatcaccgaccgccagacgggggattatttttgtccttgaaggccacatttcccaggccttgaactttgacgggaggagctggaatccaggaggcatctttgtgggagagccccaggtgaccatggccgaccgggcggcagctgagagggcttgcaaagacccgaaccccatcatcgacggccgcaaggccaacgtgaacctggcatatctgggcgccaagccgcggagcctccagacgggctttgccattggggtgcagcagctgcaccccaccttgatccagcggacttacgggctgaccccgcactacatctacccaccagccatcgtgcagcccagcgtggtgatcccagccgcccctgtcccgtcgctgtcctcgccctacattgagtacacgccggccagcccggcctacgcccagtacccaccggccacctatgaccagtacccatacgccgcctcgcctgccacggctgccagcttcgtgggctacagctaccctgccgccgtgccccaggccctctcagccgcagcacccgcgggcaccactttcgtgcagtaccaggcgccgcagctgcagcctgacaggatgcagtgaggggcgttcctgccccgaggactgtggcattgtcaccttcacagcagacagagctgccaggccatgatgggctggcgacagcccggctgagcttcagtgaggtgccaccagcacccgtgcctccgaagaccgctcgggcattccgcctgcgccctgggacagcggagagacggcttctctttaatctaggtcccattgtgtcttgagggaggactttaagaatgactgagaactatttaaagacgcaatcccaggttccttgcacaccatggcagcctctccttgcaccttctcctgcctctccacactccaggttccctcaggcttgtgtccccactgctgcatcgtggcggggtgtcacagaccctctgcagcccctggctgccctggactgtgcagagatgcctgactccagggaaacctgaaagcaagaagttaatggactgtttattgtaacttgatcctcccgagctgtgagcgcagtctgaggtgtgaggacacggcctcctgttggagtcccattttctccatcagggcacgtgggcggcttcctcaagcccggaggagctcccaggcgcacaggggccgccggtaacaggggccgccggccaaaggcccctttccagtcatagcactgaagttgcaacttttttcttgtaattgttttgctactaagataatttcagaagttcagtctattttttcagcggatactgccgccaccaagaatccaaaacctatttttgacttggagagacttgcttttgttggttccgcccgtggagacgacgatagtgtttctgtataataaagtgtctgccggctcgcgggccaggatcctctcggtgggatgggcaccacagacaggaggcccctcaggcccgtgcgggccactgtctgctgccgcctgccggggtggcagagtgagttgtctcaggaccccgtcactgcgacgttgacactcctctcccttcccttcctccccaactccccaaacactgtggaaggggagaaggaagtgatccacagcattcaggccacttggggtctagaccatggtggtgccagcctggggggggcagtggccctcagctctgcccgctggagcggttgagtgcagaagggtgcgcctcttccctctacccccgcaccacctgctgtgtgccagcctgagacggttcctgcctgtcttgggggttggtggagggtggaggcagttctgccagccgtggcagggctgctatggggcatccagggctgtgggggtctggaggaggggacatgaggtgagaggtatcctggccgagggcggggggcagcggggggtctccctccggacctacctcagggagctgagcgtgcaggcgctccagggcaggcctgggacagagtcaaggctcagagaataaaggtagctaatctcatcataatatttttattagaatgttctgatgataaaaataaaacttgttttctttaaagaaaaa

SEQ ID NO: 437372 - DNA, 2126 bp, Homo sapiens
gcggcggatgcagtacaaccggcgctttgtcaacgttgtgcccacctttggcaagaagaaggacaccacgttcaccaagatcttcgtgggcggcctgccgtaccacactaccgacgcctcgctcaggaagtacttcgagggcttcggcgacatcgaggaggccgtggtcatcaccgaccgccagacgggcaagtcccgcggctacggcttcgtgaccatggccgaccgggcggcagctgagagggcttgcaaagacccgaaccccatcatcgacggccgcaaggccaacgtgaacctggcatatctgggcgccaagccgcggagcctccagacgggctgaccccgcactacatctacccaccagccatcgtgcagcccagcgtggtgatcccagccgcccctgtcccgtcgctgtcctcgccctacattgagtacacgccggccagcccggcctacgcccagtacccaccggccacctatgaccagtacccatacgccgcctcgcctgccacggctgccagcttcgtgggctacagctaccctgccgccgtgccccaggccctctcagccgcagcacccgcgggcaccactttcgtgcagtaccaggcgccgcagctgcagcctgacaggatgcagtgaggggcgttcctgccccgaggactgtggcattgtcaccttcacagcagacagagctgccaggccatgatgggctggcgacagcccggctgagcttcagtgaggtgccaccagcacccgtgcctccgaagaccgctcgggcattccgcctgcgccctgggacagcggagagacggcttctctttaatctaggtcccattgtgtcttgagggaggactttaagaatgactgagaactatttaaagacgcaatcccaggttccttgcacaccatggcagcctctccttgcaccttctcctgcctctccacactccaggttccctcaggcttgtgtccccactgctgcatcgtggcggggtgtcacagaccctctgcagcccctggctgccctggactgtgcagagatgcctgactccagggaaacctgaaagcaagaagttaatggactgtttattgtaacttgatcctcccgagctgtgagcgcagtctgaggtgtgaggacacggcctcctgttggagtcccattttctccatcagggcacgtgggcggcttcctcaagcccggaggagctcccaggcgcacaggggccgccggtaacaggggccgccggccaaaggcccctttccagtcatagcactgaagttgcaacttttttcttgtaattgttttgctactaagataatttcagaagttcagtctattttttcagcggatactgccgccaccaagaatccaaaacctatttttgacttggagagacttgcttttgttggttccgcccgtggagacgacgatagtgtttctgtataataaagtgtctgccggctcgcgggccaggatcctctcggtgggatgggcaccacagacaggaggcccctcaggcccgtgcgggccactgtctgctgccgcctgccggggtggcagagtgagttgtctcaggaccccgtcactgcgacgttgacactcctctcccttcccttcctccccaactccccaaacactgtggaaggggagaaggaagtgatccacagcattcaggccacttggggtctagaccatggtggtgccagcctggggggggcagtggccctcagctctgcccgctggagcggttgagtgcagaagggtgcgcctcttccctctacccccgcaccacctgctgtgtgccagcctgagacggttcctgcctgtcttgggggttggtggagggtggaggcagttctgccagccgtggcagggctgctatggggcatccagggctgtgggggtctggaggaggggacatgaggtgagaggtatcctggccgagggcggggggcagcggggggtctccctccggacctacctcagggagctgagcgtgcaggcgctccagggcaggcctgggacagagtcaaggctcagagaataaaggtagctaatctcatcataatatttttattagaatgttctgatgataaaaataaaacttgttttctttaaagaaaaa

SEQ ID NO: 437373 - DNA, 2125 bp, Homo sapiens
gcgcagcgcggcgcactcggcgcgcacggcgggagcggcgcgcgagtggtcgggcctggcggctggacgggcgcccctcgctgccccgcgcgctccccgccgccccccatgagcgcaccccgcgcggcccgggtccgtaggcggcggggcgccccccatgctgctgcagcccgcgccgtgcgccccgagcgcgggcttcccgcggcccctggccgcccccggcgccatgcacggctcgcagaaggacaccacgttcaccaagatcttcgtgggcggcctgccgtaccacactaccgacgcctcgctcaggaagtacttcgagggcttcggcgacatcgaggaggccgtggtcatcaccgaccgccagacgggcaagtcccgcggctacggcttcgtgaccatggccgaccgggcggcagctgagagggcttgcaaagacccgaaccccatcatcgacggccgcaaggccaacgtgaacctggcatatctgggcgccaagccgcggagcctccagacgggctttgccattggggtgcagcagctgcaccccaccttgatccagcggacttacgggctgaccccgcactacatctacccaccagccatcgtgcagcccagcgtggtgatcccagccgcccctgtcccgtcgctgtcctcgccctacattgagtacacgccggccagcccggcctacgcccagtacccaccggccacctatgaccagtacccatacgccgcctcgcctgccacggctgccagcttcgtgggctacagctaccctgccgccgtgccccaggccctctcagccgcagcacccgcgggcaccactttcgtgcagtaccaggcgccgcagctgcagcctgacaggatgcagtgaggggcgttcctgccccgaggactgtggcattgtcaccttcacagcagacagagctgccaggccatgatgggctggcgacagcccggctgagcttcagtgaggtgccaccagcacccgtgcctccgaagaccgctcgggcattccgcctgcgccctgggacagcggagagacggcttctctttaatctaggtcccattgtgtcttgagggaggactttaagaatgactgagaactatttaaagacgcaatcccaggttccttgcacaccatggcagcctctccttgcaccttctcctgcctctccacactccaggttccctcaggcttgtgtccccactgctgcatcgtggcggggtgtcacagaccctctgcagcccctggctgccctggactgtgcagagatgcctgactccagggaaacctgaaagcaagaagttaatggactgtttattgtaacttgatcctcccgagctgtgagcgcagtctgaggtgtgaggacacggcctcctgttggagtcccattttctccatcagggcacgtgggcggcttcctcaagcccggaggagctcccaggcgcacaggggccgccggtaacaggggccgccggccaaaggcccctttccagtcatagcactgaagttgcaacttttttcttgtaattgttttgctactaagataatttcagaagttcagtctattttttcagcggatactgccgccaccaagaatccaaaacctatttttgacttggagagacttgcttttgttggttccgcccgtggagacgacgatagtgtttctgtataataaagtgtctgccggctcgcgggccaggatcctctcggtgggatgggcaccacagacaggaggcccctcaggcccgtgcgggccactgtctgctgccgcctgccggggtggcagagtgagttgtctcaggaccccgtcactgcgacgttgacactcctctcccttcccttcctccccaactccccaaacactgtggaaggggagaaggaagtgatccacagcattcaggccacttggggtctagaccatggtggtgccagcctggggggggcagtggccctcagctctgcccgctggagcggttgagtgcagaagggtgcgcctcttccctctacccgacactgtgtgtgcgcggaggtctgctgtggggtgggggggggggtgcccggggggttggcccggggggtgggggcgggggtcgggggggggggccggccggg

SEQ ID NO: 437374 - DNA, 1070 bp, Homo sapiens
gcgcagcgcggcgcactcggcgcgcacggcgggagcggcgcgcgagtggtcgggcctggcggctggacgggcgcccctcgctgccccgcgcgctccccgccgccccccatgagcgcaccccgcgcggcccgggtccgtaggcggcggggcgccccccatgctgctgcagcccgcgccgtgcgccccgagcgcgggcttcccgcggcccctggccgcccccggcgccatgcacggctcgcagaaggacaccacgttcaccaagatcttcgtgggcggcctgccgtaccacactaccgacgcctcgctcaggaagtacttcgagggcttcggcgacatcgaggaggccgtggtcatcaccgaccgccagacgggcaagtcccgcggctacggcttcgtgaccatggccgaccgggcggcagctgagagggcttgcaaagacccgaaccccatcatcgacggccgcaaggccaacgtgaacctggcatatctgggcgccaagccgcggagcctccagacgggctttgccattggggtgcagcagctgcaccccaccttgatccagcggacttacgggctgaccccgcactacatctacccaccagccatcgtgcagcccagcgtggtgatcccagccgcccctgtcccgtcgctgtcctcgccctacattgagtacacgccggccagcccggcctacgcccagtacccaccggccacctatgaccagtacccatacgccgcctcgcctgccacggctgccagcttcgtgggctacagctaccctgccgccgtgccccaggccctctcagccgcagcacccgcgggcaccactttcgtgcagtaccaggcgccgcagctgcagcctgacaggatgcagtgaggggcgttcctgccccgaggactgtggcattgtctccctccggacctacctcagggagctgagcgtgcaggcgctccagggcaggcctgggacagagtcaaggctcagagaataaaggtagctaatctcatcataatatttttattagaatgttctgatgataaaaataaaacttgttttctttaaagaaaaa

SEQ ID NO: 437375 - DNA, 1612 bp, Homo sapiens
gtcttgctgcaggccatgctcacttccatctgctctcttttccctgcattcttcttttgtgtcacttccctgacttgtcagtacttctaattctcatagtcctgctatcccctacaacctcgtgccttagtattaatagggtacagcagggaaaaactcacttagtttccattttgttcttggagaagaaaaatttggagacatttccaaaatggcatgtacatcataattcttattgccaacatttataagaaactttgactgtagtgattatcaagatacatgcttggaatatttattccctctttccccacctttcaaaataaggatttagagcaggagttggcagggccaaatccagcctgcagcctattttggaaataaagttattgggatgctgccatccccattcactcacatactgtgcatgactgctttcatgcttccatgacagagctgagtggttgcaacagagaccgaatggcctgcaaagcctaaaatatttactttctggacccttacaggaagtttgccaacccctgatttagaaagtgaaaacctaaatggggaagtcttacatactttaacgtatcttagcaagcactgttatgttaatgtatatggacagcacttaaaatatatcaataaacaattatgatcagtaaacatttatttagagcctattgtggcccagagagtgtcctgtgctcagaggctataaataccaataacaccccatctctcccctcatggaactcagtctcaggggagaggaatatgtaaatgataagtgcaatgcaatgtgacataaataatatcaagaagaagagaatcagaaaaaaaaggagaggggactgattaattctgtcagaagtagagaaaggcttaacaagataagtgatatgtattaaattgtaggaaatgttagataaacagctttctttagtattttttgagttagaaagcaagtttttagcttggggtcagaatatttttagagaaaaagtttaaaatgtgcctaaatctgaaattctggatttaaaaaagtgaaaatctgcatgttcctctaatacctaatgacgaattctaattgcagaaggatgccaataactaaaaccacaaaatgaaccctatgtataccggtgaccttctttactcagaattaattaacacaagcacttgtttcttgcagagcactttgctgtaatttagaacaaattaagggaaaaaatcattcaagtgctgttttcttcacaccatgaagtaagcatgatggaccaaagttaactaatttaaaatattatcatccatttcttgtaattatgaatagcaataccatcttttttcttcaaaaaaaaaaaaagacatcatgatctatgctattttcaacttgtttcctgtgcttctattaatggaaattgatttttcaagattaatgtaaaatgtgtttctgtttctcccattaagtctcttatttatattagatccaatgtatatgttcctggatatttttcaaataaatatatttttaatataatacagcaaattgtaaattgttaaaggaccatttataatgttttctccttgccctccctagcactgaaactgtggt

SEQ ID NO: 437376 - DNA, 979 bp, Homo sapiens
cttcacactgttgtttgtgaattaacttgagctccttgagttcctacttctaagagattatttaaactttactttttaccttcttagtatacagagcttggtaggagctggaaacccgactcacagatttaggaaacagtgggttcttgtccctgtggacatcagaacttgggggacggagagatagagaaccagaaggcagaacaaggaaaaactcaaagaaaggaatggggaggaatggaaacgtaacaggacatgttgcctcagtgagtcaccaagggctttgggagttccttaggcccaaaatgtggttctgtggaggctgagggacaaacttcaggacagagcatgcccttaatcgatgtgcttaagccactggctcgggcagtccttaagcaagggctcctctgatcagacaaggaattgtttccttcccttttactccagatgacacctaaaggtgcaaaagaaaaccatctctgcacactaccaaacagacagtgcgtgaacgaagcagaccctcctgaccacagccaaggactggagagcttggtgaaactggtgctcaaggtagaaattccctgcgattgctactgcaacttatactaaacgtcccaagtgaagtgaagggagaaaaaagagatattaagcaagaaggcccacttgtttatgcattgctttagaagataatctgtaattgcatattaataagtaaagttaacgttacacttaaataataacctatatttgttactgcatttgaatcactcttatctgacttagttggtcaggaaatcaaaaaagtcagttaaaggaaggaatcataagaattgttttaacattagtttaaacattttattttctattagaacacataaacgtacatttatccactaatcttttggtgtagggacaatgtcattccttttaatattccttcctgttggttttatgcataaagtatatctataaggtgttg

SEQ ID NO: 437377 - DNA, 5176 bp, Homo sapiens
cccgagtgtcggttcactgtggagacagcggtggcggagtgggtctccagggctctgggctggcaaggcccccggaggggtggggcgcggaggaggctacagatccgcttccgcgcggcggggccgggtgcttgggacgcggctctgggctcccgggataaggggctcccgggacaaggggctcccggagagcccagtggttagcgatgctgctgtcgccgtcgctgctgctgctgctgctgctggggggcgccgcgggctgcgccgagggtgtggcggcggcgcttacccccgagcggctcctggagtggcaggataaaggaatatttgttatccaaagtgagagtctcaagaaatgcattcaagcaggtaaatcggttctgaccctcggtagaactggaagcaagcaagcaaacaagcacatgctgtggaaatgggtttcaaaccatggcctctttaacataggaggcagcggttgcctgggcctgaatttctccgccccagagcagccattaagcttatatgaatgtgactccaccctcgtttccttacggtggcgctgtaacaggaagatgatcacaggcccgctgcagtactctgtccaggtggcgcatgacaacacagtggtggcctcacggaagtatattcataagtggatttcttatgggtcaggtggtggagacatttgtgaatatctacacaaagatttgcatacaatcaaagggaacacccacgggatgccgtgtatgtttcccttccagtataaccatcagtggcatcatgaatgtacccgtgaaggtcgggaagatgacttactgtggtgtgccacgacaagccgttatgaaagagatgaaaagtggggattttgccctgatcccacctctgcagaagtaggttgtgatactatttgggagaaggacctcaattcacacatttgctaccagttcaacctgctttcatctctctcttggagtgaggcacattcttcatgccagatgcaaggaggtacgctgttaagtattacagatgaaactgaagaaaatttcataagggagcacatgagcagtaaaacagtggaggtgtgggttggcctcaatcagcttgatgaagacgctggctggcagtggtctgatggaacgccgctcaactatctgaattggagcccagaggtaaattttgagccatttgttgaagatcactgtggaacatttagttcatttatgccaagtgcctggaggagtcgggattgtgagtccaccttgccatatatatgtaaaaaatatctaaaccacattgatcatgaaatagttgaaaaagatgcgtggaaatattatgctacccactgtgagcctggctggaatccctacaatcgtaattgctacaaacttcagaaagaagaaaagacctggcatgaggctctgcgttcttgtcaggctgataacagtgcattaatagacataacctcattagcagaggtggagtttcttgtaaccctccttggagatgaaaatgcatcagaaacatggattggtttgagcagcaataaaattccagtttcctttgaatggtctaatgactcttcagtcatctttactaattggcacacacttgagccccacatttttccaaatagaagccagctgtgtgtctcagcagagcagtctgagggacactggaaagtcaaaaattgtgaagaaagacttttttacatttgtaaaaaagcaggccatgtcctctctgatgctgaatcaggatgtcaagagggatgggaggagacatggtggattctgttacaaaattgacacagtccttcgaagctttgaccaagcttccagcggttattactgtcctcctgcacttgtaaccattacaaacaggtttgaacaggcttttattaccagtttgatcagtagtgtggtaaaaatgaaggacagttatttttggatagctcttcaggaccaaaatgatacgggagaatacacttggaagccagtagggcagaaacccgagccggtgcagtacacacactggaacacacaccagccgcgctacagtggtggctgtgttgccatgcgaggaaggcatccacttggtcgctgggaagtgaagcactgtcggcactttaaggcaatgtccttgtgcaagcagccagttgaaaatcaggaaaaagcagagtatgaagagagatggccctttcacccctgctatttggactgggagtcagagcctggtctggccagttgcttcaaggtatttcatagtgaaaaagttctgatgaaaagaacatggagagaagctgaagcattttgcgaagaatttggagctcatcttgcaagctttgcccatattgaggaagagaattttgtgaatgagctcttacattcaaaatttaattggacagaagaaaggcagttctggattggatttaataaaagaaacccactgaatgccggctcatgggagtggtctgatagaactcctgttgtctcttcgtttttagacaacacttattttggagaagatgcaagaaactgtgctgtttataagccaaacaaaacattgctgcccttacactgtggttccaaacgtgaatggatatgcaaaatcccaagagatgtgaaacccaagattccgttctggtaccagtacgatgtaccctggctcttttatcaggatgcagaatacctttttcatacctttgcctcagaatggttgaactttgagtttgtctgtagctggctgcacagtgatcttctcacaattcattctgcacatgagcaagaattcatccacagcaaaataaaagcgctatccaagtatggtgcaagttggtggattggacttcaagaagaaagagccaatgatgaatttcgctggagagatggaacaccagtgatataccagaactgggacacaggaagagaaagaactgtgaataatcagagccagagatgtggctttatttcttctataacaggactctggggtagtgaagagtgttcagtttctatgcctagtatctgtaagcgaaaaaaggtttggctcatagagaaaaagaaagatacaccaaaacaacatggaacgtgtcccaaaggatggctatattttaactataagtgccttctgctgaatatccccaaagacccaagcagttggaagaactggacgcatgctcaacatttctgtgctgaagaaggggggaccctggtcgccattgaaagtgaggtggagcaagctttcattactatgaatctttttggccagaccaccagtgtgtggataggtttacaaaatgatgattatgaaacatggctaaatggaaagcctgtggtatattctaactggtctccatttgatataataaatattccaagtcacaataccactgaagttcagaaacacattcctctctgtgccttactctcaagtaatcctaattttcatttcactggaaaatggtattttgaagactgtggaaaggaaggctatgggtttgtttgtgaaaaaatgcaagatacttctggacacggtgtaaatacatctgatatgtatccaatgcccaataccttagaatatggaaacagaacttacaaaataattaatgcaaatatgacttggtatgcagcaataaaaacctgcctgatgcacaaagcacaactggtcagcatcacagaccagtatcaccagtccttcctcactgttgtcctcaaccggctaggatatgcccactggattggactgttcaccacagataatggtcttaattttgactggtctgatggcaccaaatcttctttcactttttggaaagatgaggagtcctccctccttggtgactgcgtttttgccgacagcaacggacgctggcatagcacagcctgcgagtcatttctgcaaggtgccatttgtcatgtgccacctgaaacaagacaatctgaacacccagagttgtgctcagaaacatctattccctggataaaatttaaaagtaattgctacagtttttctacagtcctagacagtatgagttttgaggctgctcatgaattttgcaaaaaggaaggttctaatcttttaacaatcaaggatgaggctgaaaatgcatttctcctagaagagctgtttgcttttggttcttctgtccagatggtttggttgaatgctcaatttgatggtaacagtaagtgatttgggtagaggagaggacataaataaatacatggttgttaaagctgatgataatggcatctgtgagccagaaaactctccttggatacgttttctgagaaaaaatagcatgaagcctaaagccatttcttccaaaaacaacattgcaacccttttctttacccttttgtcttttaaaataatcccagaacaccaaaaataaaaacaaacaataacatgtttatctttacccttagcaggaagatgcttggctggaactttgtgttcacagacttagtcattgcataccaaaaccatatttactggaaaatatcccaggtttctaaatgttataaaagcacaatagagttatggaaatgtttccatgatgaactgtgctgttaggattcttatttgctactcataaaaaccagagtttgtaataaaatggaagcatggtattcttttctttatgtaattgatggttattgaaaggtacttgtgaagaaaattattttaattggtatggagagcttgttacagtggtgtaccaaggttgggggtgagcctaccctttcgaggaggagtattttaatcaccaacattgtttagaatttcaagcagatggtgataataaaaagcagaccaacttttagttagctgtattgttagttttaaattattttcagacaatacactattgcccacacatgggatggactctcctaccgcccctacccccttggtacatggctggcttggtattaaagaaattcactgtaaaatctttttagaaagtgagccattttgtaatgatgaagatgttaggacttcaaaggatttttctttactcgattagttttgtttatcaaatgatttctttaaatcgattatatatatatatggaatatttcaaaattcaaactgtcacattaagaaacatgataacctaaatgacctaaataagaacactgtacctaaaataaagaggcaactttattaatgccta

SEQ ID NO: 437378 - DNA, 966 bp, Homo sapiens
agtgggtgtagttaatggcattactggatagaataaatataaaaatatcaagacaaaaattcaaggagttttaaaggagtaagagaagaaagttatgtaggtggtaaaagagtatgcaaaaatatctcttggtatttaactaaatgagattgtgtccttaatttcccttttattctttttaagggatgggaggagacatggtggattctgttacaaaattgacacagtccttcgaagctttgaccaagcttccagcggttattactgtcctcctgcacttgtaaccattacaaacaggtttgaacaggcttttattaccagtttgatcagtagtgtggtaaaaatgaaggacagttatttttggatagctcttcaggaccaaaatgatacgggagaatacacttggaagccagtagggcagaaacccgagccggtgcagtacacacactggaacacacaccagccgcgctacagtggtggctgtgttgccatgcgaggaaggcatccacttggtcgctgggaagtgaagcactgtcggcactttaaggcaatgtccttgtgcaagcagccagttgaaaatcaggaaaaagcagagtatgaagagagatggccctttcacccctgctatttggactgggagtcagagcctggtctggccagttgcttcaaggtatttcatagtgaaaaagttctgatgaaaagaacatggagagaagctgaagcattttgcgaagaatttggagctcatcttgcaagctttgcccatattgaggaagagaattttgtgaatgagctcttacattcaaaatttaattggtaaatacttgttaattatgaaaaattacagtcaaatattctatctcccagtaatggcttctgagggtgagtatcccaagtagttgtttaaaattcccatatttgtattatgcccaaagccaagaaaaataaatatacatatagttttat

SEQ ID NO: 437379 - DNA, 1188 bp, Homo sapiens
gtcttagtatgtttgataaccatgcacataattcataatgagtcagcaattttctcacagatgaaaccataaagtggtttgatggaactcccacagaccagtcaaactggggcattcggaagccagacacagactacttcaagccccatcattgtgttgccttgaggatccctgaaggattatggcagctatccccgtgtcaagaaaaaaaaggctttatatgtaaaatggaggcaggtaggtaaagtcagagagtaattcttcattttgattctaccttaactaatgttgactgacttctttagcatttaaaggttttaaaatccaagttgagagagtattcagatagattctgacattattgttgtgttctgcaccaaacaagtcagagaatagttcagctccttctttctctgatatgagaaaaaaaatcattataagtcaactcaaagactatgatttttcttgtgtcacccaggttgatcacctaatgggcaaaaaatcattttccctcaagcaaatagaactaggaatgtaaaccagcaaccttcattctggtgactgctactcagaatttttaaggtttatgtttggcctcaggaaatataatctaggcttatgtatatttgctgtagacaagaagatgtgattccctgttgcaagcataatgtgtcataaaagtcacattttaacttaatcatcagtaacatacttagtgtttagtaattaaaaaaaacaataattttagaaatctaagctagaaaattctagtcactgatggtgggaaaatgtctataataattacagcaatttctagatgtcagtattataaaggagggattgctgtggcctgtactgctagagaaggcttcagacatgaggttttaggatcccaaaggatgaagagaattatagaagctggaacagaggaggaaaaggcccagcctgattaaaggcagcaactaagaatgtgtttcaattagagcaaagggctcacgtcagggggtgatgggaataaaattggatggtaatgtaggatcctttcacagagtgccaggctaaagagctgaactttgtggtggaagagacagaccccctatgtgctctgtagacacctgtgatgaagtagaactcatgaggatatgaagagaaacatttgtaatttgagtgattaaactaggaacgaaa

SEQ ID NO: 437380 - DNA, 537 bp, Homo sapiens
ctgagcccagaagttgaaggctgcagtgagctatggttgcaccactgcactcctgcctgggcaactgaatgagaccccacctcaaaaaagtgctgttctagaaacagaggtactaagagcactttgctgtaatttagaacaaattaagggaaaaaatcattcaagtgctgttttcttcacaccatgaagtaagcatgatggaccaaagttaactaatttaaaatattatcatccatttcttgtaattatgaatagcaataccatcttttttcttcaaaaaaaaaaaaagacatcatgatctatgctattttcaacttgtttcctgtgcttctattaatggaaattgatttttcaagattaatgtaaaatgtgtttctgtttctcccattaagtctcttatttatattagatccaatgtatatgttcctggatatttttcaaataaatatatttttaatataatacagcaaattgtaaattgttaaaggaccatttataatgttttctccttgccctccctagcactgaaactgtggt

SEQ ID NO: 437381 - DNA, 649 bp, Homo sapiens
ctgagcccagaagttgaaggctgcagtgagctatggttgcaccactgcactcctgcctgggcaactgaatgagaccccacctcaaaaaagtgctgttctagaaacagaggtactaagatgacacctaaaggtgcaaaagaaaaccatctctgcacactaccaaacagacagtgcgtgaacgaagcagaccctcctgaccacagccaaggactggagagcttggtgaaactggtgctcaaggtagaaattccctgcgattgctactgcaacttatactaaacgtcccaagtgaagtgaagggagaaaaaagagatattaagcaagaaggcccacttgtttatgcattgctttagaagataatctgtaattgcatattaataagtaaagttaacgttacacttaaataataacctatatttgttactgcatttgaatcactcttatctgacttagttggtcaggaaatcaaaaaagtcagttaaaggaaggaatcataagaattgttttaacattagtttaaacattttattttctattagaacacataaacgtacatttatccactaatcttttggtgtagggacaatgtcattccttttaatattccttcctgttggttttatgcataaagtatatctataaggtgttg

SEQ ID NO: 437382 - DNA, 6101 bp, Homo sapiens
caggtagcaggctggcagctaacatgtattccccagctgggtcccacagcttttccacgggaaactcacccaaatcccttcttccagctccggggaggagagcttaggggcatatcacaaaacacctgctttctccgcctgtccatgtggcctctggtttctgccaccgtaatggtggtccgtcacctctcgtgtttcaaggtgtggtgccatagctagtggcctgggcatctacctgcttctgcctgccccacccagcaagccatctcctactaagagtctatccccatatagcaagaggtccccacctccacccttgtactcctgagaaacattgtattctgaccagtattgaatcccgtatcagatcacaaagcagcatttcactgatagcctttcggttttctataggaacttgatggtagagagtttcattcagtggctcttgattcagcagctgtgttcctaacattcaggcacttgtctgagaaagacagtgttgtcatatccattggcacccagtgtccctcccggggagccctgagtattattaccaatccctctctctaaccaattgtgtgagcacaccttctctgtcagtaacagacctgagtggattggcaggtaacccttgttcccatatggccaattaggtcttagatcagagctctcccattagctccagtaagaccttttatgcttcccaagaaactcctctgttttatgcaaatacagcccttcaggtggaccctgcccaacaactccagatctgtgggaaatggctggcaactgtcgcatatcgcacttagatatgcacactgagatcctcatgacgctagttaattatatatgaaaatttcatgccacatctttgatttttgtttcagataaaggaatatttgttatccaaagtgagagtctcaagaaatgcattcaagcaggtaaatcggttctgaccctcggtagaactggaagcaagcaagcaaacaagcacatgctgtggaaatgggtttcaaaccatggcctctttaacataggaggcagcggttgcctgggcctgaatttctccgccccagagcagccattaagcttatatgaatgtgactccaccctcgtttccttacggtggcgctgtaacaggaagatgatcacaggcccgctgcagtactctgtccaggtggcgcatgacaacacagtggtggcctcacggaagtatattcataagtggatttcttatgggtcaggtggtggagacatttgtgaatatctacacaaagatttgcatacaatcaaagggaacacccacgggatgccgtgtatgtttcccttccagtataaccatcagtggcatcatgaatgtacccgtgaaggtcgggaagatgacttactgtggtgtgccacgacaagccgttatgaaagagatgaaaagtggggattttgccctgatcccacctctgcagaagtaggttgtgatactatttgggagaaggacctcaattcacacatttgctaccagttcaacctgctttcatctctctcttggagtgaggcacattcttcatgccagatgcaaggaggtacgctgttaagtattacagatgaaactgaagaaaatttcataagggagcacatgagcagtaaaacagtggaggtgtgggttggcctcaatcagcttgatgaagacgctggctggcagtggtctgatggaacgccgctcaactatctgaattggagcccagaggtaaattttgagccatttgttgaagatcactgtggaacatttagttcatttatgccaagtgcctggaggagtcgggattgtgagtccaccttgccatatatatgtaaaaaatatctaaaccacattgatcatgaaatagttgaaaaagatgcgtggaaatattatgctacccactgtgagcctggctggaatccctacaatcgtaattgctacaaacttcagaaagaagaaaagacctggcatgaggctctgcgttcttgtcaggctgataacagtgcattaatagacataacctcattagcagaggtggagtttcttgtaaccctccttggagatgaaaatgcatcagaaacatggattggtttgagcagcaataaaattccagtttcctttgaatggtctaatgactcttcagtcatctttactaattggcacacacttgagccccacatttttccaaatagaagccagctgtgtgtctcagcagagcagtctgagggacactggaaagtcaaaaattgtgaagaaagacttttttacatttgtaaaaaagcaggccatgtcctctctgatgctgaatcaggatgtcaagagggatgggaggagacatggtggattctgttacaaaattgacacagtccttcgaagctttgaccaagcttccagcggttattactgtcctcctgcacttgtaaccattacaaacaggtttgaacaggcttttattaccagtttgatcagtagtgtggtaaaaatgaaggacagttatttttggatagctcttcaggaccaaaatgatacgggagaatacacttggaagccagtagggcagaaacccgagccggtgcagtacacacactggaacacacaccagccgcgctacagtggtggctgtgttgccatgcgaggaaggcatccacttggtcgctgggaagtgaagcactgtcggcactttaaggcaatgtccttgtgcaagcagccagttgaaaatcaggaaaaagcagagtatgaagagagatggccctttcacccctgctatttggactgggagtcagagcctggtctggccagttgcttcaaggtatttcatagtgaaaaagttctgatgaaaagaacatggagagaagctgaagcattttgcgaagaatttggagctcatcttgcaagctttgcccatattgaggaagagaattttgtgaatgagctcttacattcaaaatttaattggacagaagaaaggcagttctggattggatttaataaaagaaacccactgaatgccggctcatgggagtggtctgatagaactcctgttgtctcttcgtttttagacaacacttattttggagaagatgcaagaaactgtgctgtttataagccaaacaaaacattgctgcccttacactgtggttccaaacgtgaatggatatgcaaaatcccaagagatgtgaaacccaagattccgttctggtaccagtacgatgtaccctggctcttttatcaggatgcagaatacctttttcatacctttgcctcagaatggttgaactttgagtttgtctgtagctggctgcacagtgatcttctcacaattcattctgcacatgagcaagaattcatccacagcaaaataaaagcgctatccaagtatggtgcaagttggtggattggacttcaagaagaaagagccaatgatgaatttcgctggagagatggaacaccagtgatataccagaactgggacacaggaagagaaagaactgtgaataatcagagccagagatgtggctttatttcttctataacaggactctggggtagtgaagagtgttcagtttctatgcctagtatctgtaagcgaaaaaaggtttggctcatagagaaaaagaaagatacaccaaaacaacatggaacgtgtcccaaaggatggctatattttaactataagtgccttctgctgaatatccccaaagacccaagcagttggaagaactggacgcatgctcaacatttctgtgctgaagaaggggggaccctggtcgccattgaaagtgaggtggagcaagctttcattactatgaatctttttggccagaccaccagtgtgtggataggtttacaaaatgatgattatgaaacatggctaaatggaaagcctgtggtatattctaactggtctccatttgatataataaatattccaagtcacaataccactgaagttcagaaacacattcctctctgtgccttactctcaagtaatcctaattttcatttcactggaaaatggtattttgaagactgtggaaaggaaggctatgggtttgtttgtgaaaaaatgcaagatacttctggacacggtgtaaatacatctgatatgtatccaatgcccaataccttagaatatggaaacagaacttacaaaataattaatgcaaatatgacttggtatgcagcaataaaaacctgcctgatgcacaaagcacaactggtcagcatcacagaccagtatcaccagtccttcctcactgttgtcctcaaccggctaggatatgcccactggattggactgttcaccacagataatggtcttaattttgactggtctgatggcaccaaatcttctttcactttttggaaagatgaggagtcctccctccttggtgactgcgtttttgccgacagcaacggacgctggcatagcacagcctgcgagtcatttctgcaaggtgccatttgtcatgtgccacctgaaacaagacaatctgaacacccagagttgtgctcagaaacatctattccctggataaaatttaaaagtaattgctacagtttttctacagtcctagacagtatgagttttgaggctgctcatgaattttgcaaaaaggaaggttctaatcttttaacaatcaaggatgaggctgaaaatgcatttctcctagaagagctgtttgcttttggttcttctgtccagatggtttggttgaatgctcaatttgatggtaacaatgaaaccataaagtggtttgatggaactcccacagaccagtcaaactggggcattcggaagccagacacagactacttcaagccccatcattgtgttgccttgaggatccctgaaggattatggcagctatccccgtgtcaagaaaaaaaaggctttatatgtaaaatggaggcagatattcacactgcagaggcgctgccagaaaaaggaccaagtcacagcatcattcctcttgcggttgtactgacactgatagtcattgtggccatttgcacactttccttctgcatatacaagcataacggtggcttcttcaggagacttgcagggtttcggaatccttactatcctgcaaccaactttagtacagtatatttagaagaaaatattctcatttctgatcttgagaagagtgaccaataataatgaggtcagagaatgccacagacaccaggtatacagagcttggtaggagctggaaacccgactcacagatttaggaaacagtgggttcttgtccctgtggacatcagaacttgggggacggagagatagagaaccagaaggcagaacaaggaaaaactcaaagaaaggaatggggaggaatggaaacgtaacaggacatgttgcctcagtgagtcaccaagggctttgggagttccttaggcccaaaatgtggttctgtggaggctgagggacaaacttcaggacagagcatgcccttaatcgatgtgcttaagccactggctcgggcagtccttaagcaagggctcctctgatcagacaaggaattgtttccttcccttttactccagatgacacctaaaggtgcaaaagaaaaccatctctgcacactaccaaacagacagtgcgtgaacgaagcagaccctcctgaccacagccaaggactggagagcttggtgaaactggtgctcaaggtagaaattccctgcgattgctactgcaacttatactaaacgtcccaagtgaagtgaagggagaaaaaagagatattaagcaagaaggcccacttgtttatgcattgctttagaagataatctgtaattgcatattaataagtaaagttaacgttacacttaaataataacctatatttgttactgcatttgaatcactcttatctgacttagttggtcaggaaatcaaaaaagtcagttaaaggaaggaatcataagaattgttttaacattagtttaaacattttattttctattagaacacataaacgtacatttatccactaatcttttggtgtagggacaatgtcattccttttaatattccttcctgttggttttatgcataaagtatatctataaggtgttg

SEQ ID NO: 437383 - DNA, 3589 bp, Homo sapiens
agtgggtgtagttaatggcattactggatagaataaatataaaaatatcaagacaaaaattcaaggagttttaaaggagtaagagaagaaagttatgtaggtggtaaaagagtatgcaaaaatatctcttggtatttaactaaatgagattgtgtccttaatttcccttttattctttttaagggatgggaggagacatggtggattctgttacaaaattgacacagtccttcgaagctttgaccaagcttccagcggttattactgtcctcctgcacttgtaaccattacaaacaggtttgaacaggcttttattaccagtttgatcagtagtgtggtaaaaatgaaggacagttatttttggatagctcttcaggaccaaaatgatacgggagaatacacttggaagccagtagggcagaaacccgagccggtgcagtacacacactggaacacacaccagccgcgctacagtggtggctgtgttgccatgcgaggaaggcatccacttggtcgctgggaagtgaagcactgtcggcactttaaggcaatgtccttgtgcaagcagccagttgaaaatcaggaaaaagcagagtatgaagagagatggccctttcacccctgctatttggactgggagtcagagcctggtctggccagttgcttcaaggtatttcatagtgaaaaagttctgatgaaaagaacatggagagaagctgaagcattttgcgaagaatttggagctcatcttgcaagctttgcccatattgaggaagagaattttgtgaatgagctcttacattcaaaatttaattggacagaagaaaggcagttctggattggatttaataaaagaaacccactgaatgccggctcatgggagtggtctgatagaactcctgttgtctcttcgtttttagacaacacttattttggagaagatgcaagaaactgtgctgtttataagccaaacaaaacattgctgcccttacactgtggttccaaacgtgaatggatatgcaaaatcccaagagatgtgaaacccaagattccgttctggtaccagtacgatgtaccctggctcttttatcaggatgcagaatacctttttcatacctttgcctcagaatggttgaactttgagtttgtctgtagctggctgcacagtgatcttctcacaattcattctgcacatgagcaagaattcatccacagcaaaataaaagcgctatccaagtatggtgcaagttggtggattggacttcaagaagaaagagccaatgatgaatttcgctggagagatggaacaccagtgatataccagaactgggacacaggaagagaaagaactgtgaataatcagagccagagatgtggctttatttcttctataacaggactctggggtagtgaagagtgttcagtttctatgcctagtatctgtaagcgaaaaaaggtttggctcatagagaaaaagaaagatacaccaaaacaacatggaacgtgtcccaaaggatggctatattttaactataagtgccttctgctgaatatccccaaagacccaagcagttggaagaactggacgcatgctcaacatttctgtgctgaagaaggggggaccctggtcgccattgaaagtgaggtggagcaagctttcattactatgaatctttttggccagaccaccagtgtgtggataggtttacaaaatgatgattatgaaacatggctaaatggaaagcctgtggtatattctaactggtctccatttgatataataaatattccaagtcacaataccactgaagttcagaaacacattcctctctgtgccttactctcaagtaatcctaattttcatttcactggaaaatggtattttgaagactgtggaaaggaaggctatgggtttgtttgtgaaaaaatgcaagatacttctggacacggtgtaaatacatctgatatgtatccaatgcccaataccttagaatatggaaacagaacttacaaaataattaatgcaaatatgacttggtatgcagcaataaaaacctgcctgatgcacaaagcacaactggtcagcatcacagaccagtatcaccagtccttcctcactgttgtcctcaaccggctaggatatgcccactggattggactgttcaccacagataatggtcttaattttgactggtctgatggcaccaaatcttctttcactttttggaaagatgaggagtcctccctccttggtgactgcgtttttgccgacagcaacggacgctggcatagcacagcctgcgagtcatttctgcaaggtgccatttgtcatgtgccacctgaaacaagacaatctgaacacccagagttgtgctcagaaacatctattccctggataaaatttaaaagtaattgctacagtttttctacagtcctagacagtatgagttttgaggctgctcatgaattttgcaaaaaggaaggttctaatcttttaacaatcaaggatgaggctgaaaatgcatttctcctagaagagctgtttgcttttggttcttctgtccagatggtttggttgaatgctcaatttgatggtaacaatgaaaccataaagtggtttgatggaactcccacagaccagtcaaactggggcattcggaagccagacacagactacttcaagccccatcattgtgttgccttgaggatccctgaaggattatggcagctatccccgtgtcaagaaaaaaaaggctttatatgtaaaatggaggcagatattcacactgcagaggcgctgccagaaaaaggaccaagtcacagcatcattcctcttgcggttgtactgacactgatagtcattgtggccatttgcacactttccttctgcatatacaagcataacggtggcttcttcaggagacttgcagggtttcggaatccttactatcctgcaaccaactttagtacagtatatttagaagaaaatattctcatttctgatcttgagaagagtgaccaataataatgaggtcagagaatgccacagacaccaggatgacacctaaaggtgcaaaagaaaaccatctctgcacactaccaaacagacagtgcgtgaacgaagcagaccctcctgaccacagccaaggactggagagcttggtgaaactggtgctcaaggtagaaattccctgcgattgctactgcaacttatactaaacgtcccaagtgaagtgaagggagaaaaaagagatattaagcaagaaggcccacttgtttatgcattgctttagaagataatctgtaattgcatattaataagtaaagttaacgttacacttaaataataacctatatttgttactgcatttgaatcactcttatctgacttagttggtcaggaaatcaaaaaagtcagttaaaggaaggaatcataagaattgttttaacattagtttaaacattttattttctattagaacacataaacgtacatttatccactaatcttttggtgtagggacaatgtcattccttttaatattccttcctgttggttttatgcataaagtatatctataaggtgttg

SEQ ID NO: 437384 - DNA, 5880 bp, Homo sapiens
caggtagcaggctggcagctaacatgtattccccagctgggtcccacagcttttccacgggaaactcacccaaatcccttcttccagctccggggaggagagcttaggggcatatcacaaaacacctgctttctccgcctgtccatgtggcctctggtttctgccaccgtaatggtggtccgtcacctctcgtgtttcaaggtgtggtgccatagctagtggcctgggcatctacctgcttctgcctgccccacccagcaagccatctcctactaagagtctatccccatatagcaagaggtccccacctccacccttgtactcctgagaaacattgtattctgaccagtattgaatcccgtatcagatcacaaagcagcatttcactgatagcctttcggttttctataggaacttgatggtagagagtttcattcagtggctcttgattcagcagctgtgttcctaacattcaggcacttgtctgagaaagacagtgttgtcatatccattggcacccagtgtccctcccggggagccctgagtattattaccaatccctctctctaaccaattgtgtgagcacaccttctctgtcagtaacagacctgagtggattggcaggtaacccttgttcccatatggccaattaggtcttagatcagagctctcccattagctccagtaagaccttttatgcttcccaagaaactcctctgttttatgcaaatacagcccttcaggtggaccctgcccaacaactccagatctgtgggaaatggctggcaactgtcgcatatcgcacttagatatgcacactgagatcctcatgacgctagttaattatatatgaaaatttcatgccacatctttgatttttgtttcagataaaggaatatttgttatccaaagtgagagtctcaagaaatgcattcaagcaggtaaatcggttctgaccctcggtagaactggaagcaagcaagcaaacaagcacatgctgtggaaatgggtttcaaaccatggcctctttaacataggaggcagcggttgcctgggcctgaatttctccgccccagagcagccattaagcttatatgaatgtgactccaccctcgtttccttacggtggcgctgtaacaggaagatgatcacaggcccgctgcagtactctgtccaggtggcgcatgacaacacagtggtggcctcacggaagtatattcataagtggatttcttatgggtcaggtggtggagacatttgtgaatatctacacaaagatttgcatacaatcaaagggaacacccacgggatgccgtgtatgtttcccttccagtataaccatcagtggcatcatgaatgtacccgtgaaggtcgggaagatgacttactgtggtgtgccacgacaagccgttatgaaagagatgaaaagtggggattttgccctgatcccacctctgcagaagtaggttgtgatactatttgggagaaggacctcaattcacacatttgctaccagttcaacctgctttcatctctctcttggagtgaggcacattcttcatgccagatgcaaggaggtacgctgttaagtattacagatgaaactgaagaaaatttcataagggagcacatgagcagtaaaacagtggaggtgtgggttggcctcaatcagcttgatgaagacgctggctggcagtggtctgatggaacgccgctcaactatctgaattggagcccagaggtaaattttgagccatttgttgaagatcactgtggaacatttagttcatttatgccaagtgcctggaggagtcgggattgtgagtccaccttgccatatatatgtaaaaaatatctaaaccacattgatcatgaaatagttgaaaaagatgcgtggaaatattatgctacccactgtgagcctggctggaatccctacaatcgtaattgctacaaacttcagaaagaagaaaagacctggcatgaggctctgcgttcttgtcaggctgataacagtgcattaatagacataacctcattagcagaggtggagtttcttgtaaccctccttggagatgaaaatgcatcagaaacatggattggtttgagcagcaataaaattccagtttcctttgaatggtctaatgactcttcagtcatctttactaattggcacacacttgagccccacatttttccaaatagaagccagctgtgtgtctcagcagagcagtctgagggacactggaaagtcaaaaattgtgaagaaagacttttttacatttgtaaaaaagcaggccatgtcctctctgatgctgaatcaggatgtcaagagggatgggaggagacatggtggattctgttacaaaattgacacagtccttcgaagctttgaccaagcttccagcggttattactgtcctcctgcacttgtaaccattacaaacaggtttgaacaggcttttattaccagtttgatcagtagtgtggtaaaaatgaaggacagttatttttggatagctcttcaggaccaaaatgatacgggagaatacacttggaagccagtagggcagaaacccgagccggtgcagtacacacactggaacacacaccagccgcgctacagtggtggctgtgttgccatgcgaggaaggcatccacttggtcgctgggaagtgaagcactgtcggcactttaaggcaatgtccttgtgcaagcagccagttgaaaatcaggaaaaagcagagtatgaagagagatggccctttcacccctgctatttggactgggagtcagagcctggtctggccagttgcttcaaggtatttcatagtgaaaaagttctgatgaaaagaacatggagagaagctgaagcattttgcgaagaatttggagctcatcttgcaagctttgcccatattgaggaagagaattttgtgaatgagctcttacattcaaaatttaattggacagaagaaaggcagttctggattggatttaataaaagaaacccactgaatgccggctcatgggagtggtctgatagaactcctgttgtctcttcgtttttagacaacacttattttggagaagatgcaagaaactgtgctgtttataagccaaacaaaacattgctgcccttacactgtggttccaaacgtgaatggatatgcaaaatcccaagagatgtgaaacccaagattccgttctggtaccagtacgatgtaccctggctcttttatcaggatgcagaatacctttttcatacctttgcctcagaatggttgaactttgagtttgtctgtagctggctgcacagtgatcttctcacaattcattctgcacatgagcaagaattcatccacagcaaaataaaagcgctatccaagtatggtgcaagttggtggattggacttcaagaagaaagagccaatgatgaatttcgctggagagatggaacaccagtgatataccagaactgggacacaggaagagaaagaactgtgaataatcagagccagagatgtggctttatttcttctataacaggactctggggtagtgaagagtgttcagtttctatgcctagtatctgtaagcgaaaaaaggtttggctcatagagaaaaagaaagatacaccaaaacaacatggaacgtgtcccaaaggatggctatattttaactataagtgccttctgctgaatatccccaaagacccaagcagttggaagaactggacgcatgctcaacatttctgtgctgaagaaggggggaccctggtcgccattgaaagtgaggtggagcaagctttcattactatgaatctttttggccagaccaccagtgtgtggataggtttacaaaatgatgattatgaaacatggctaaatggaaagcctgtggtatattctaactggtctccatttgatataataaatattccaagtcacaataccactgaagttcagaaacacattcctctctgtgccttactctcaagtaatcctaattttcatttcactggaaaatggtattttgaagactgtggaaaggaaggctatgggtttgtttgtgaaaaaatgcaagatacttctggacacggtgtaaatacatctgatatgtatccaatgcccaataccttagaatatggaaacagaacttacaaaataattaatgcaaatatgacttggtatgcagcaataaaaacctgcctgatgcacaaagcacaactggtcagcatcacagaccagtatcaccagtccttcctcactgttgtcctcaaccggctaggatatgcccactggattggactgttcaccacagataatggtcttaattttgactggtctgatggcaccaaatcttctttcactttttggaaagatgaggagtcctccctccttggtgactgcgtttttgccgacagcaacggacgctggcatagcacagcctgcgagtcatttctgcaaggtgccatttgtcatgtgccacctgaaacaagacaatctgaacacccagagttgtgctcagaaacatctattccctggataaaatttaaaagtaattgctacagtttttctacagtcctagacagtatgagttttgaggctgctcatgaattttgcaaaaaggaaggttctaatcttttaacaatcaaggatgaggctgaaaatgcatttctcctagaagagctgtttgcttttggttcttctgtccagatggtttggttgaatgctcaatttgatggtaacaatgaaaccataaagtggtttgatggaactcccacagaccagtcaaactggggcattcggaagccagacacagactacttcaagccccatcattgtgttgccttgaggatccctgaaggattatggcagctatccccgtgtcaagaaaaaaaaggctttatatgtaaaatggaggcaggtaggtaaagtcagagagtaattcttcattttgattctaccttaactaatgttgactgacttctttagcatttaaaggttttaaaatccaagttgagagagtattcagatagattctgacattattgttgtgttctgcaccaaacaagtcagagaatagttcagctccttctttctctgatatgagaaaaaaaatcattataagtcaactcaaagactatgatttttcttgtgtcacccaggttgatcacctaatgggcaaaaaatcattttccctcaagcaaatagaactaggaatgtaaaccagcaaccttcattctggtgactgctactcagaatttttaaggtttatgtttggcctcaggaaatataatctaggcttatgtatatttgctgtagacaagaagatgtgattccctgttgcaagcataatgtgtcataaaagtcacattttaacttaatcatcagtaacatacttagtgtttagtaattaaaaaaaacaataattttagaaatctaagctagaaaattctagtcactgatggtgggaaaatgtctataataattacagcaatttctagatgtcagtattataaaggagggattgctgtggcctgtactgctagagaaggcttcagacatgaggttttaggatcccaaaggatgaagagaattatagaagctggaacagaggaggaaaaggcccagcctgattaaaggcagcaactaagaatgtgtttcaattagagcaaagggctcacgtcagggggtgatgggaataaaattggatggtaatgtaggatcctttcacagagtgccaggctaaagagctgaactttgtggtggaagagacagaccccctatgtgctctgtagacacctgtgatgaagtagaactcatgaggatatgaagagaaacatttgtaatttgagtgattaaactaggaacgaaa

SEQ ID NO: 437385 - DNA, 3118 bp, Homo sapiens
caggtagcaggctggcagctaacatgtattccccagctgggtcccacagcttttccacgggaaactcacccaaatcccttcttccagctccggggaggagagcttaggggcatatcacaaaacacctgctttctccgcctgtccatgtggcctctggtttctgccaccgtaatggtggtccgtcacctctcgtgtttcaaggtgtggtgccatagctagtggcctgggcatctacctgcttctgcctgccccacccagcaagccatctcctactaagagtctatccccatatagcaagaggtccccacctccacccttgtactcctgagaaacattgtattctgaccagtattgaatcccgtatcagatcacaaagcagcatttcactgatagcctttcggttttctataggaacttgatggtagagagtttcattcagtggctcttgattcagcagctgtgttcctaacattcaggcacttgtctgagaaagacagtgttgtcatatccattggcacccagtgtccctcccggggagccctgagtattattaccaatccctctctctaaccaattgtgtgagcacaccttctctgtcagtaacagacctgagtggattggcaggtaacccttgttcccatatggccaattaggtcttagatcagagctctcccattagctccagtaagaccttttatgcttcccaagaaactcctctgttttatgcaaatacagcccttcaggtggaccctgcccaacaactccagatctgtgggaaatggctggcaactgtcgcatatcgcacttagatatgcacactgagatcctcatgacgctagttaattatatatgaaaatttcatgccacatctttgatttttgtttcagataaaggaatatttgttatccaaagtgagagtctcaagaaatgcattcaagcaggtaaatcggttctgaccctcggtagaactggaagcaagcaagcaaacaagcacatgctgtggaaatgggtttcaaaccatggcctctttaacataggaggcagcggttgcctgggcctgaatttctccgccccagagcagccattaagcttatatgaatgtgactccaccctcgtttccttacggtggcgctgtaacaggaagatgatcacaggcccgctgcagtactctgtccaggtggcgcatgacaacacagtggtggcctcacggaagtatattcataagtggatttcttatgggtcaggtggtggagacatttgtgaatatctacacaaagatttgcatacaatcaaagggaacacccacgggatgccgtgtatgtttcccttccagtataaccatcagtggcatcatgaatgtacccgtgaaggtcgggaagatgacttactgtggtgtgccacgacaagccgttatgaaagagatgaaaagtggggattttgccctgatcccacctctgcagaagtaggttgtgatactatttgggagaaggacctcaattcacacatttgctaccagttcaacctgctttcatctctctcttggagtgaggcacattcttcatgccagatgcaaggaggtacgctgttaagtattacagatgaaactgaagaaaatttcataagggagcacatgagcagtaaaacagtggaggtgtgggttggcctcaatcagcttgatgaagacgctggctggcagtggtctgatggaacgccgctcaactatctgaattggagcccagaggtaaattttgagccatttgttgaagatcactgtggaacatttagttcatttatgccaagtgcctggaggagtcgggattgtgagtccaccttgccatatatatgtaaaaaatatctaaaccacattgatcatgaaatagttgaaaaagatgcgtggaaatattatgctacccactgtgagcctggctggaatccctacaatcgtaattgctacaaacttcagaaagaagaaaagacctggcatgaggctctgcgttcttgtcaggctgataacagtgcattaatagacataacctcattagcagaggtggagtttcttgtaaccctccttggagatgaaaatgcatcagaaacatggattggtttgagcagcaataaaattccagtttcctttgaatggtctaatgactcttcagtcatctttactaattggcacacacttgagccccacatttttccaaatagaagccagctgtgtgtctcagcagagcagtctgagggacactggaaagtcaaaaattgtgaagaaagacttttttacatttgtaaaaaagcaggccatgtcctctctgatgctgaatcaggatgtcaagagggatgggaggagacatggtggattctgttacaaaattgacacagtccttcgaagctttgaccaagcttccagcggttattactgtcctcctgcacttgtaaccattacaaacaggtttgaacaggcttttattaccagtttgatcagtagtgtggtaaaaatgaaggacagttatttttggatagctcttcaggaccaaaatgatacgggagaatacacttggaagccagtagggcagaaacccgagccggtgcagtacacacactggaacacacaccagccgcgctacagtggtggctgtgttgccatgcgaggaaggcatccacttggtcgctgggaagtgaagcactgtcggcactttaaggcaatgtccttgtgcaagcagccagttgaaaatcaggaaaaagcagagtatgaagagagatggccctttcacccctgctatttggactgggagtcagagcctggtctggccagttgcttcaaggtatttcatagtgaaaaagttctgatgaaaagaacatggagagaagctgaagcattttgcgaagaatttggagctcatcttgcaagctttgcccatattgaggaagagaattttgtgaatgagctcttacattcaaaatttaattggtaaatacttgttaattatgaaaaattacagtcaaatattctatctcccagtaatggcttctgagggtgagtatcccaagtagttgtttaaaattcccatatttgtattatgcccaaagccaagaaaaataaatatacatatagttttat

SEQ ID NO: 437386 - DNA, 5640 bp, Homo sapiens
  misc_feature (5026)..(5026): n is a, c, g, or t
  misc_feature (5052)..(5052): n is a, c, g, or t
  misc_feature (5240)..(5240): n is a, c, g, or t
  misc_feature (5287)..(5287): n is a, c, g, or t
  misc_feature (5403)..(5403): n is a, c, g, or t
  misc_feature (5408)..(5408): n is a, c, g, or t
  misc_feature (5428)..(5429): n is a, c, g, or t
  misc_feature (5431)..(5432): n is a, c, g, or t
  misc_feature (5443)..(5443): n is a, c, g, or t
  misc_feature (5445)..(5445): n is a, c, g, or t
  misc_feature (5455)..(5455): n is a, c, g, or t
  misc_feature (5473)..(5473): n is a, c, g, or t
  misc_feature (5505)..(5505): n is a, c, g, or t
  misc_feature (5521)..(5521): n is a, c, g, or t
  misc_feature (5538)..(5538): n is a, c, g, or t
  misc_feature (5590)..(5590): n is a, c, g, or t
cccgagtgtcggttcactgtggagacagcggtggcggagtgggtctccagggctctgggctggcaaggcccccggaggggtggggcgcggaggaggctacagatccgcttccgcgcggcggggccgggtgcttgggacgcggctctgggctcccgggataaggggctcccgggacaaggggctcccggagagcccagtggttagcgatgctgctgtcgccgtcgctgctgctgctgctgctgctggggggcgccgcgggctgcgccgagggtgtggcggcggcgcttacccccgagcggctcctggagtggcaggataaaggaatatttgttatccaaagtgagagtctcaagaaatgcattcaagcaggtaaatcggttctgaccctcggtagaactggaagcaagcaagcaaacaagcacatgctgtggaaatgggtttcaaaccatggcctctttaacataggaggcagcggttgcctgggcctgaatttctccgccccagagcagccattaagcttatatgaatgtgactccaccctcgtttccttacggtggcgctgtaacaggaagatgatcacaggcccgctgcagtactctgtccaggtggcgcatgacaacacagtggtggcctcacggaagtatattcataagtggatttcttatgggtcaggtggtggagacatttgtgaatatctacacaaagatttgcatacaatcaaagggaacacccacgggatgccgtgtatgtttcccttccagtataaccatcagtggcatcatgaatgtacccgtgaaggtcgggaagatgacttactgtggtgtgccacgacaagccgttatgaaagagatgaaaagtggggattttgccctgatcccacctctgcagaagtaggttgtgatactatttgggagaaggacctcaattcacacatttgctaccagttcaacctgctttcatctctctcttggagtgaggcacattcttcatgccagatgcaaggaggtacgctgttaagtattacagatgaaactgaagaaaatttcataagggagcacatgagcagtaaaacagtggaggtgtgggttggcctcaatcagcttgatgaagacgctggctggcagtggtctgatggaacgccgctcaactatctgaattggagcccagaggtaaattttgagccatttgttgaagatcactgtggaacatttagttcatttatgccaagtgcctggaggagtcgggattgtgagtccaccttgccatatatatgtaaaaaatatctaaaccacattgatcatgaaatagttgaaaaagatgcgtggaaatattatgctacccactgtgagcctggctggaatccctacaatcgtaattgctacaaacttcagaaagaagaaaagacctggcatgaggctctgcgttcttgtcaggctgataacagtgcattaatagacataacctcattagcagaggtggagtttcttgtaaccctccttggagatgaaaatgcatcagaaacatggattggtttgagcagcaataaaattccagtttcctttgaatggtctaatgactcttcagtcatctttactaattggcacacacttgagccccacatttttccaaatagaagccagctgtgtgtctcagcagagcagtctgagggacactggaaagtcaaaaattgtgaagaaagacttttttacatttgtaaaaaagcaggccatgtcctctctgatgctgaatcaggatgtcaagagggatgggaggagacatggtggattctgttacaaaattgacacagtccttcgaagctttgaccaagcttccagcggttattactgtcctcctgcacttgtaaccattacaaacaggtttgaacaggcttttattaccagtttgatcagtagtgtggtaaaaatgaaggacagttatttttggatagctcttcaggaccaaaatgatacgggagaatacacttggaagccagtagggcagaaacccgagccggtgcagtacacacactggaacacacaccagccgcgctacagtggtggctgtgttgccatgcgaggaaggcatccacttggtcgctgggaagtgaagcactgtcggcactttaaggcaatgtccttgtgcaagcagccagttgaaaatcaggaaaaagcagagtatgaagagagatggccctttcacccctgctatttggactgggagtcagagcctggtctggccagttgcttcaaggtatttcatagtgaaaaagttctgatgaaaagaacatggagagaagctgaagcattttgcgaagaatttggagctcatcttgcaagctttgcccatattgaggaagagaattttgtgaatgagctcttacattcaaaatttaattggacagaagaaaggcagttctggattggatttaataaaagaaacccactgaatgccggctcatgggagtggtctgatagaactcctgttgtctcttcgtttttagacaacacttattttggagaagatgcaagaaactgtgctgtttataagccaaacaaaacattgctgcccttacactgtggttccaaacgtgaatggatatgcaaaatcccaagagatgtgaaacccaagattccgttctggtaccagtacgatgtaccctggctcttttatcaggatgcagaatacctttttcatacctttgcctcagaatggttgaactttgagtttgtctgtagctggctgcacagtgatcttctcacaattcattctgcacatgagcaagaattcatccacagcaaaataaaagcgctatccaagtatggtgcaagttggtggattggacttcaagaagaaagagccaatgatgaatttcgctggagagatggaacaccagtgatataccagaactgggacacaggaagagaaagaactgtgaataatcagagccagagatgtggctttatttcttctataacaggactctggggtagtgaagagtgttcagtttctatgcctagtatctgtaagcgaaaaaaggtttggctcatagagaaaaagaaagatacaccaaaacaacatggaacgtgtcccaaaggatggctatattttaactataagtgccttctgctgaatatccccaaagacccaagcagttggaagaactggacgcatgctcaacatttctgtgctgaagaaggggggaccctggtcgccattgaaagtgaggtggagcaagctttcattactatgaatctttttggccagaccaccagtgtgtggataggtttacaaaatgatgattatgaaacatggctaaatggaaagcctgtggtatattctaactggtctccatttgatataataaatattccaagtcacaataccactgaagttcagaaacacattcctctctgtgccttactctcaagtaatcctaattttcatttcactggaaaatggtattttgaagactgtggaaaggaaggctatgggtttgtttgtgaaaaaatgcaagatacttctggacacggtgtaaatacatctgatatgtatccaatgcccaataccttagaatatggaaacagaacttacaaaataattaatgcaaatatgacttggtatgcagcaataaaaacctgcctgatgcacaaagcacaactggtcagcatcacagaccagtatcaccagtccttcctcactgttgtcctcaaccggctaggatatgcccactggattggactgttcaccacagataatggtcttaattttgactggtctgatggcaccaaatcttctttcactttttggaaagatgaggagtcctccctccttggtgactgcgtttttgccgacagcaacggacgctggcatagcacagcctgcgagtcatttctgcaaggtgccatttgtcatgtgccacctgaaacaagacaatctgaacacccagagttgtgctcagaaacatctattccctggataaaatttaaaagtaattgctacagtttttctacagtcctagacagtatgagttttgaggctgctcatgaattttgcaaaaaggaaggttctaatcttttaacaatcaaggatgaggctgaaaatgcatttctcctagaagagctgtttgcttttggttcttctgtccagatggtttggttgaatgctcaatttgatggtaacaatgaaaccataaagtggtttgatggaactcccacagaccagtcaaactggggcattcggaagccagacacagactacttcaagccccatcattgtgttgccttgaggatccctgaaggattatggcagctatccccgtgtcaagaaaaaaaaggctttatatgtaaaatggaggcagatattcacactgcagaggcgctgccagaaaaaggaccaagtcacagcatcattcctcttgcggttgtactgacactgatagtcattgtggccatttgcacactttccttctgcatatacaagcataacggtggcttcttcaggagacttgcagggtttcggaatccttactatcctgcaaccaactttagtacagtatatttagaagaaaatattctcatttctgatcttgagaagagtgaccaataataatgaggtcagagaatgccacagacaccaggaccagggtaagtaaagaagactaaacaggagtctcatctgtctttccctttacagcacagatgccattagaatgtgaattgggtcactattttaattattcttgaagtgattactggttttgaatcttaaccaaatcagatgggttttgatttattcatttccctaaactgtgatccattcttaaaaggggtaaattatgcattggttatttttcagaaagacaagaactattaaaagaaactccctattgaaaactctgaaatcaatgcgaataatagtttttgcattaatgtatctctactaaaatttgggggaattttaaaactaatctggtatctattcagacatttacctgcactcgtaccattaagaaagacagaaagaagcnaaaaaaaattaatcttgtatatgagnggaaaaggaaagggcttctgagaggattcttagttgtttcttttgaattccttttaatagcaggatttggaaaatactaatttctgtgcttaagggtcacaggttctgggctctcaactgatatttaaggtgacattcatttttattaggtctaacatctcaagctaaaggagaaagaaaaatacctncttttaaatggcaaagaccttcattagcagcacacttttataaacanccatatagttaaaatgtggccttaaactttcaattactaaatgatgattaagttggatattttaaaatgtcttatacataagcttaaagtaatatattgaaactttaacagttgtnctgtnaaaactcatggactttctgnnannctaaatatatnanataatatgtnacactcttaataactggnagatataaaatgtaacttggatttaaaggagnagagctaaagatctgnattatagtctcattagnaccagacagatgttgttgagaagtactaaataaattagtaatctagatatcnttattatgtaaatgagtttaggtgttctatttaataaactattttctgga

SEQ ID NO: 437387 - DNA, 5741 bp, Homo sapiens
caggtagcaggctggcagctaacatgtattccccagctgggtcccacagcttttccacgggaaactcacccaaatcccttcttccagctccggggaggagagcttaggggcatatcacaaaacacctgctttctccgcctgtccatgtggcctctggtttctgccaccgtaatggtggtccgtcacctctcgtgtttcaaggtgtggtgccatagctagtggcctgggcatctacctgcttctgcctgccccacccagcaagccatctcctactaagagtctatccccatatagcaagaggtccccacctccacccttgtactcctgagaaacattgtattctgaccagtattgaatcccgtatcagatcacaaagcagcatttcactgatagcctttcggttttctataggaacttgatggtagagagtttcattcagtggctcttgattcagcagctgtgttcctaacattcaggcacttgtctgagaaagacagtgttgtcatatccattggcacccagtgtccctcccggggagccctgagtattattaccaatccctctctctaaccaattgtgtgagcacaccttctctgtcagtaacagacctgagtggattggcaggtaacccttgttcccatatggccaattaggtcttagatcagagctctcccattagctccagtaagaccttttatgcttcccaagaaactcctctgttttatgcaaatacagcccttcaggtggaccctgcccaacaactccagatctgtgggaaatggctggcaactgtcgcatatcgcacttagatatgcacactgagatcctcatgacgctagttaattatatatgaaaatttcatgccacatctttgatttttgtttcagataaaggaatatttgttatccaaagtgagagtctcaagaaatgcattcaagcaggtaaatcggttctgaccctcggtagaactggaagcaagcaagcaaacaagcacatgctgtggaaatgggtttcaaaccatggcctctttaacataggaggcagcggttgcctgggcctgaatttctccgccccagagcagccattaagcttatatgaatgtgactccaccctcgtttccttacggtggcgctgtaacaggaagatgatcacaggcccgctgcagtactctgtccaggtggcgcatgacaacacagtggtggcctcacggaagtatattcataagtggatttcttatgggtcaggtggtggagacatttgtgaatatctacacaaagatttgcatacaatcaaagggaacacccacgggatgccgtgtatgtttcccttccagtataaccatcagtggcatcatgaatgtacccgtgaaggtcgggaagatgacttactgtggtgtgccacgacaagccgttatgaaagagatgaaaagtggggattttgccctgatcccacctctgcagaagtaggttgtgatactatttgggagaaggacctcaattcacacatttgctaccagttcaacctgctttcatctctctcttggagtgaggcacattcttcatgccagatgcaaggaggtacgctgttaagtattacagatgaaactgaagaaaatttcataagggagcacatgagcagtaaaacagtggaggtgtgggttggcctcaatcagcttgatgaagacgctggctggcagtggtctgatggaacgccgctcaactatctgaattggagcccagaggtaaattttgagccatttgttgaagatcactgtggaacatttagttcatttatgccaagtgcctggaggagtcgggattgtgagtccaccttgccatatatatgtaaaaaatatctaaaccacattgatcatgaaatagttgaaaaagatgcgtggaaatattatgctacccactgtgagcctggctggaatccctacaatcgtaattgctacaaacttcagaaagaagaaaagacctggcatgaggctctgcgttcttgtcaggctgataacagtgcattaatagacataacctcattagcagaggtggagtttcttgtaaccctccttggagatgaaaatgcatcagaaacatggattggtttgagcagcaataaaattccagtttcctttgaatggtctaatgactcttcagtcatctttactaattggcacacacttgagccccacatttttccaaatagaagccagctgtgtgtctcagcagagcagtctgagggacactggaaagtcaaaaattgtgaagaaagacttttttacatttgtaaaaaagcaggccatgtcctctctgatgctgaatcaggatgtcaagagggatgggaggagacatggtggattctgttacaaaattgacacagtccttcgaagctttgaccaagcttccagcggttattactgtcctcctgcacttgtaaccattacaaacaggtttgaacaggcttttattaccagtttgatcagtagtgtggtaaaaatgaaggacagttatttttggatagctcttcaggaccaaaatgatacgggagaatacacttggaagccagtagggcagaaacccgagccggtgcagtacacacactggaacacacaccagccgcgctacagtggtggctgtgttgccatgcgaggaaggcatccacttggtcgctgggaagtgaagcactgtcggcactttaaggcaatgtccttgtgcaagcagccagttgaaaatcaggaaaaagcagagtatgaagagagatggccctttcacccctgctatttggactgggagtcagagcctggtctggccagttgcttcaaggtatttcatagtgaaaaagttctgatgaaaagaacatggagagaagctgaagcattttgcgaagaatttggagctcatcttgcaagctttgcccatattgaggaagagaattttgtgaatgagctcttacattcaaaatttaattggacagaagaaaggcagttctggattggatttaataaaagaaacccactgaatgccggctcatgggagtggtctgatagaactcctgttgtctcttcgtttttagacaacacttattttggagaagatgcaagaaactgtgctgtttataagccaaacaaaacattgctgcccttacactgtggttccaaacgtgaatggatatgcaaaatcccaagagatgtgaaacccaagattccgttctggtaccagtacgatgtaccctggctcttttatcaggatgcagaatacctttttcatacctttgcctcagaatggttgaactttgagtttgtctgtagctggctgcacagtgatcttctcacaattcattctgcacatgagcaagaattcatccacagcaaaataaaagcgctatccaagtatggtgcaagttggtggattggacttcaagaagaaagagccaatgatgaatttcgctggagagatggaacaccagtgatataccagaactgggacacaggaagagaaagaactgtgaataatcagagccagagatgtggctttatttcttctataacaggactctggggtagtgaagagtgttcagtttctatgcctagtatctgtaagcgaaaaaaggtttggctcatagagaaaaagaaagatacaccaaaacaacatggaacgtgtcccaaaggatggctatattttaactataagtgccttctgctgaatatccccaaagacccaagcagttggaagaactggacgcatgctcaacatttctgtgctgaagaaggggggaccctggtcgccattgaaagtgaggtggagcaagctttcattactatgaatctttttggccagaccaccagtgtgtggataggtttacaaaatgatgattatgaaacatggctaaatggaaagcctgtggtatattctaactggtctccatttgatataataaatattccaagtcacaataccactgaagttcagaaacacattcctctctgtgccttactctcaagtaatcctaattttcatttcactggaaaatggtattttgaagactgtggaaaggaaggctatgggtttgtttgtgaaaaaatgcaagatacttctggacacggtgtaaatacatctgatatgtatccaatgcccaataccttagaatatggaaacagaacttacaaaataattaatgcaaatatgacttggtatgcagcaataaaaacctgcctgatgcacaaagcacaactggtcagcatcacagaccagtatcaccagtccttcctcactgttgtcctcaaccggctaggatatgcccactggattggactgttcaccacagataatggtcttaattttgactggtctgatggcaccaaatcttctttcactttttggaaagatgaggagtcctccctccttggtgactgcgtttttgccgacagcaacggacgctggcatagcacagcctgcgagtcatttctgcaaggtgccatttgtcatgtgccacctgaaacaagacaatctgaacacccagagttgtgctcagaaacatctattccctggataaaatttaaaagtaattgctacagtttttctacagtcctagacagtatgagttttgaggctgctcatgaattttgcaaaaaggaaggttctaatcttttaacaatcaaggatgaggctgaaaatgcatttctcctagaagagctgtttgcttttggttcttctgtccagatggtttggttgaatgctcaatttgatggtaacaatgaaaccataaagtggtttgatggaactcccacagaccagtcaaactggggcattcggaagccagacacagactacttcaagccccatcattgtgttgccttgaggatccctgaaggattatggcagctatccccgtgtcaagaaaaaaaaggctttatatgtaaaatggaggcagatattcacactgcagaggcgctgccagaaaaaggaccaagtcacagcatcattcctcttgcggttgtactgacactgatagtcattgtggccatttgcacactttccttctgcatatacaagcataacggtggcttcttcaggagacttgcagggtttcggaatccttactatcctgcaaccaactttagtacagtatatttagaagaaaatattctcatttctgatcttgagaagagtgaccaataataatgaggtcagagaatgccacagacaccaggatgacacctaaaggtgcaaaagaaaaccatctctgcacactaccaaacagacagtgcgtgaacgaagcagaccctcctgaccacagccaaggactggagagcttggtgaaactggtgctcaaggtagaaattccctgcgattgctactgcaacttatactaaacgtcccaagtgaagtgaagggagaaaaaagagatattaagcaagaaggcccacttgtttatgcattgctttagaagataatctgtaattgcatattaataagtaaagttaacgttacacttaaataataacctatatttgttactgcatttgaatcactcttatctgacttagttggtcaggaaatcaaaaaagtcagttaaaggaaggaatcataagaattgttttaacattagtttaaacattttattttctattagaacacataaacgtacatttatccactaatcttttggtgtagggacaatgtcattccttttaatattccttcctgttggttttatgcataaagtatatctataaggtgttg

SEQ ID NO: 437388 - DNA, 4176 bp, Homo sapiens
gttgttcaaaggcctctgacacaggtgtctctatcggccatcttgctgccatccctcctctccttacttctttgtaccttcactagctcatccggaaaatgaaatactgaggttcatttgatcctagatctaaatctagatcatagattagacccttctcaactctgaagatctagaattccatgatatatgtcattttgtatatttctgtttttcccatttttaaagtaatcatattaatggcaatttacataagctgtaataagtaatgttaaaataattgtggaaaatgacattgttttttgttggtttaaaaagaaaaagatgcgtggaaatattatgctacccactgtgagcctggctggaatccctacaatcgtaattgctacaaacttcagaaagaagaaaagacctggcatgaggctctgcgttcttgtcaggctgataacagtgcattaatagacataacctcattagcagaggtggagtttcttgtaaccctccttggagatgaaaatgcatcagaaacatggattggtttgagcagcaataaaattccagtttcctttgaatggtctaatgactcttcagtcatctttactaattggcacacacttgagccccacatttttccaaatagaagccagctgtgtgtctcagcagagcagtctgagggacactggaaagtcaaaaattgtgaagaaagacttttttacatttgtaaaaaagcaggccatgtcctctctgatgctgaatcaggatgtcaagagggatgggaggagacatggtggattctgttacaaaattgacacagtccttcgaagctttgaccaagcttccagcggttattactgtcctcctgcacttgtaaccattacaaacaggtttgaacaggcttttattaccagtttgatcagtagtgtggtaaaaatgaaggacagttatttttggatagctcttcaggaccaaaatgatacgggagaatacacttggaagccagtagggcagaaacccgagccggtgcagtacacacactggaacacacaccagccgcgctacagtggtggctgtgttgccatgcgaggaaggcatccacttggtcgctgggaagtgaagcactgtcggcactttaaggcaatgtccttgtgcaagcagccagttgaaaatcaggaaaaagcagagtatgaagagagatggccctttcacccctgctatttggactgggagtcagagcctggtctggccagttgcttcaaggtatttcatagtgaaaaagttctgatgaaaagaacatggagagaagctgaagcattttgcgaagaatttggagctcatcttgcaagctttgcccatattgaggaagagaattttgtgaatgagctcttacattcaaaatttaattggacagaagaaaggcagttctggattggatttaataaaagaaacccactgaatgccggctcatgggagtggtctgatagaactcctgttgtctcttcgtttttagacaacacttattttggagaagatgcaagaaactgtgctgtttataagccaaacaaaacattgctgcccttacactgtggttccaaacgtgaatggatatgcaaaatcccaagagatgtgaaacccaagattccgttctggtaccagtacgatgtaccctggctcttttatcaggatgcagaatacctttttcatacctttgcctcagaatggttgaactttgagtttgtctgtagctggctgcacagtgatcttctcacaattcattctgcacatgagcaagaattcatccacagcaaaataaaagcgctatccaagtatggtgcaagttggtggattggacttcaagaagaaagagccaatgatgaatttcgctggagagatggaacaccagtgatataccagaactgggacacaggaagagaaagaactgtgaataatcagagccagagatgtggctttatttcttctataacaggactctggggtagtgaagagtgttcagtttctatgcctagtatctgtaagcgaaaaaaggtttggctcatagagaaaaagaaagatacaccaaaacaacatggaacgtgtcccaaaggatggctatattttaactataagtgccttctgctgaatatccccaaagacccaagcagttggaagaactggacgcatgctcaacatttctgtgctgaagaaggggggaccctggtcgccattgaaagtgaggtggagcaagctttcattactatgaatctttttggccagaccaccagtgtgtggataggtttacaaaatgatgattatgaaacatggctaaatggaaagcctgtggtatattctaactggtctccatttgatataataaatattccaagtcacaataccactgaagttcagaaacacattcctctctgtgccttactctcaagtaatcctaattttcatttcactggaaaatggtattttgaagactgtggaaaggaaggctatgggtttgtttgtgaaaaaatgcaagatacttctggacacggtgtaaatacatctgatatgtatccaatgcccaataccttagaatatggaaacagaacttacaaaataattaatgcaaatatgacttggtatgcagcaataaaaacctgcctgatgcacaaagcacaactggtcagcatcacagaccagtatcaccagtccttcctcactgttgtcctcaaccggctaggatatgcccactggattggactgttcaccacagataatggtcttaattttgactggtctgatggcaccaaatcttctttcactttttggaaagatgaggagtcctccctccttggtgactgcgtttttgccgacagcaacggacgctggcatagcacagcctgcgagtcatttctgcaaggtgccatttgtcatgtgccacctgaaacaagacaatctgaacacccagagttgtgctcagaaacatctattccctggataaaatttaaaagtaattgctacagtttttctacagtcctagacagtatgagttttgaggctgctcatgaattttgcaaaaaggaaggttctaatcttttaacaatcaaggatgaggctgaaaatgcatttctcctagaagagctgtttgcttttggttcttctgtccagatggtttggttgaatgctcaatttgatggtaacaatgaaaccataaagtggtttgatggaactcccacagaccagtcaaactggggcattcggaagccagacacagactacttcaagccccatcattgtgttgccttgaggatccctgaaggattatggcagctatccccgtgtcaagaaaaaaaaggctttatatgtaaaatggaggcagatattcacactgcagaggcgctgccagaaaaaggaccaagtcacagcatcattcctcttgcggttgtactgacactgatagtcattgtggccatttgcacactttccttctgcatatacaagcataacggtggcttcttcaggagacttgcagggtttcggaatccttactatcctgcaaccaactttagtacagtatatttagaagaaaatattctcatttctgatcttgagaagagtgaccaataataatgaggtcagagaatgccacagacaccaggatgacacctaaaggtgcaaaagaaaaccatctctgcacactaccaaacagacagtgcgtgaacgaagcagaccctcctgaccacagccaaggactggagagcttggtgaaactggtgctcaaggtagaaattccctgcgattgctactgcaacttatactaaacgtcccaagtgaagtgaagggagaaaaaagagatattaagcaagaaggcccacttgtttatgcattgctttagaagataatctgtaattgcatattaataagtaaagttaacgttacacttaaataataacctatatttgttactgcatttgaatcactcttatctgacttagttggtcaggaaatcaaaaaagtcagttaaaggaaggaatcataagaattgttttaacattagtttaaacattttattttctattagaacacataaacgtacatttatccactaatcttttggtgtagggacaatgtcattccttttaatattccttcctgttggttttatgcataaagtatatctataaggtgttg

SEQ ID NO: 437389 - DNA, 1273 bp, Homo sapiens
aaatcataactggcttttcttcacagaaacaagacaatctgaacacccagagttgtgctcagaaacatctattccctggataaaatttaaaagtaattgctacagtttttctacagtcctagacagtatgagttttgaggctgctcatgaattttgcaaaaaggaaggttctaatcttttaacaatcaaggatgaggctgaaaatgcatttctcctagaagagctgtttgcttttggttcttctgtccagatggtttggttgaatgctcaatttgatggtaacaatgaaaccataaagtggtttgatggaactcccacagaccagtcaaactggggcattcggaagccagacacagactacttcaagccccatcattgtgttgccttgaggatccctgaaggattatggcagctatccccgtgtcaagaaaaaaaaggctttatatgtaaaatggaggcagatattcacactgcagaggcgctgccagaaaaaggaccaagtcacagcatcattcctcttgcggttgtactgacactgatagtcattgtggccatttgcacactttccttctgcatatacaagcataacggtggcttcttcaggagacttgcagggtttcggaatccttactatcctgcaaccaactttagtacagtatatttagaagaaaatattctcatttctgatcttgagaagagtgaccaataataatgaggtcagagaatgccacagacaccaggatgacacctaaaggtgcaaaagaaaaccatctctgcacactaccaaacagacagtgcgtgaacgaagcagaccctcctgaccacagccaaggactggagagcttggtgaaactggtgctcaaggtagaaattccctgcgattgctactgcaacttatactaaacgtcccaagtgaagtgaagggagaaaaaagagatattaagcaagaaggcccacttgtttatgcattgctttagaagataatctgtaattgcatattaataagtaaagttaacgttacacttaaataataacctatatttgttactgcatttgaatcactcttatctgacttagttggtcaggaaatcaaaaaagtcagttaaaggaaggaatcataagaattgttttaacattagtttaaacattttattttctattagaacacataaacgtacatttatccactaatcttttggtgtagggacaatgtcattccttttaatattccttcctgttggttttatgcataaagtatatctataaggtgttg

SEQ ID NO: 437390 - DNA, 3403 bp, Homo sapiens
caggtagcaggctggcagctaacatgtattccccagctgggtcccacagcttttccacgggaaactcacccaaatcccttcttccagctccggggaggagagcttaggggcatatcacaaaacacctgctttctccgcctgtccatgtggcctctggtttctgccaccgtaatggtggtccgtcacctctcgtgtttcaaggtgtggtgccatagctagtggcctgggcatctacctgcttctgcctgccccacccagcaagccatctcctactaagagtctatccccatatagcaagaggtccccacctccacccttgtactcctgagaaacattgtattctgaccagtattgaatcccgtatcagatcacaaagcagcatttcactgatagcctttcggttttctataggaacttgatggtagagagtttcattcagtggctcttgattcagcagctgtgttcctaacattcaggcacttgtctgagaaagacagtgttgtcatatccattggcacccagtgtccctcccggggagccctgagtattattaccaatccctctctctaaccaattgtgtgagcacaccttctctgtcagtaacagacctgagtggattggcaggtaacccttgttcccatatggccaattaggtcttagatcagagctctcccattagctccagtaagaccttttatgcttcccaagaaactcctctgttttatgcaaatacagcccttcaggtggaccctgcccaacaactccagatctgtgggaaatggctggcaactgtcgcatatcgcacttagatatgcacactgagatcctcatgacgctagttaattatatatgaaaatttcatgccacatctttgatttttgtttcagataaaggaatatttgttatccaaagtgagagtctcaagaaatgcattcaagcaggtaaatcggttctgaccctcggtagaactggaagcaagcaagcaaacaagcacatgctgtggaaatgggtttcaaaccatggcctctttaacataggaggcagcggttgcctgggcctgaatttctccgccccagagcagccattaagcttatatgaatgtgactccaccctcgtttccttacggtggcgctgtaacaggaagatgatcacaggcccgctgcagtactctgtccaggtggcgcatgacaacacagtggtggcctcacggaagtatattcataagtggatttcttatgggtcaggtggtggagacatttgtgaatatctacacaaagatttgcatacaatcaaagggaacacccacgggatgccgtgtatgtttcccttccagtataaccatcagtggcatcatgaatgtacccgtgaaggtcgggaagatgacttactgtggtgtgccacgacaagccgttatgaaagagatgaaaagtggggattttgccctgatcccacctctgcagaagtaggttgtgatactatttgggagaaggacctcaattcacacatttgctaccagttcaacctgctttcatctctctcttggagtgaggcacattcttcatgccagatgcaaggaggtacgctgttaagtattacagatgaaactgaagaaaatttcataagggagcacatgagcagtaaaacagtggaggtgtgggttggcctcaatcagcttgatgaagacgctggctggcagtggtctgatggaacgccgctcaactatctgaattggagcccagaggtaaattttgagccatttgttgaagatcactgtggaacatttagttcatttatgccaagtgcctggaggagtcgggattgtgagtccaccttgccatatatatgtaaaaaatatctaaaccacattgatcatgaaatagttgaaaaagatgcgtggaaatattatgctacccactgtgagcctggctggaatccctacaatcgtaattgctacaaacttcagaaagaagaaaagacctggcatgaggctctgcgttcttgtcaggctgataacagtgcattaatagacataacctcattagcagaggtggagtttcttgtaaccctccttggagatgaaaatgcatcagaaacatggattggtttgagcagcaataaaattccagtttcctttgaatggtctaatgactcttcagtcatctttactaattggcacacacttgagccccacatttttccaaatagaagccagctgtgtgtctcagcagagcagtctgagggacactggaaagtcaaaaattgtgaagaaagacttttttacatttgtaaaaaagcaggccatgtcctctctgatgctgaatcaggatgtcaagagggatgggaggagacatggtggattctgttacaaaattgacacagtccttcgaagctttgaccaagcttccagcggttattactgtcctcctgcacttgtaaccattacaaacaggtttgaacaggcttttattaccagtttgatcagtagtgtggtaaaaatgaaggacagttatttttggatagctcttcaggaccaaaatgatacgggagaatacacttggaagccagtagggcagaaacccgagccggtgcagtacacacactggaacacacaccagccgcgctacagtggtggctgtgttgccatgcgaggaaggcatccacttggtcgctgggaagtgaagcactgtcggcactttaaggcaatgtccttgtgcaagcagccagttgaaaatcaggaaaaagcagagtatgaagagagatggccctttcacccctgctatttggactgggagtcagagcctggtctggccagttgcttcaaggtatttcatagtgaaaaagttctgatgaaaagaacatggagagaagctgaagcattttgcgaagaatttggagctcatcttgcaagctttgcccatattgaggaagagaattttgtgaatgagctcttacattcaaaatttaattggacagaagaaaggcagttctggattggatttaataaaagaaacccactgaatgccggctcatgggagtggtctgatagaactcctgttgtctcttcgtttttagacaacacttattttggagaagatgcaagaaactgtgctgtttataagccaaacaaaacattgctgcccttacactgtggttccaaacgtgaatggatatgcaaaatcccaagagatgtgaaacccaagattccgttctggtaccagtacgatgtaccctggctcttttatcaggatgcagaatacctttttcatacctttgcctcagaatggttgaactttgagtttgtctgtagctggctgcacagtgatcttctcacaattcattctgcacatgagcaagaattcatccacagcaaaataaaagcggtacttgaacataactcaccacg

SEQ ID NO: 437391 - DNA, 1536 bp, Homo sapiens
agttgttgttgaggtggcgcggcgctaagatggcggcggcggcggcggcggccgtggcgggggtggggcgcggtggcggtggcgcggagccacggcaggagcggagccgggcccggggctgggccggcgtcgaacgcagcgaaggccggaggatggaaccaggtgaggagctggaagaggagggctctccaggtggccgtgaggatggcttcaccgccgagcacctggctgcagaggccatggcagctgacatggacccctggctagtgtttgatgcccgcacaacgcctgccactgagctggatgcctggctggccaagtacccaccatcccaagttacccgctatggggaccccggttcacccaactcagagcctgtgggctggattgcagtgtatgggcagggctacagccccaactccggggacgtgcagggcctgcaggcagcctgggaagctctgcagaccagtgggcggcccatcacaccgggtaccctgcgccagctcgccatcacccaccacgtgctctcgggcaagtggcttatgcatctggcaccgggcttcaagctggaccacgcctgggctggcattgcccgggccgtggttgaaggccggcttcaggtggccaaggtgagcccacgtgccaaggagggtgggcgccaggtcatctgtgtttacacggacgacttcacggaccgcttgggtgtactggaggcggattcagccatccgtgcagcgggcattaagtgcctgctcacctacaagcctgatgtctacacctacctgggcatctaccgggccaatcgctggcacctctgccccactctctatgagagccgtttccagcttgggggtagtgcccgtggctcccgagtgcttgaccgtgccaacaacgtggaactgacctagaggggccaaattggggagactgcccactcccccctccatgctggggttggatcctcctgtcttcctccttgtcccatgaaggccacaccccccagctctggggactcctaggtcacttgggaactacctgcatcttcagtccccttgaacttctgccctctgttcagggctgacacaagccccacaggctggggggctccggttccctgagggatgagccttcagcctccctttgtaatgctgctcctctccactgcccagcaccatgagttgggtgcagacacctagaaggagagacttcttggaacgctcatcccccgctatacctccccttcctcctgcatctccccttctttccttccccctcaggagagagaaaacttagtgcttccagcccttcttggagccttcatggtccaggggtaggggccccactggcctgagcatgccattttgaggggagggtagttgtgcctacttatcccctggcagaggggatgccaggaccatggacatgaggcttgcccatccctgccaacttacacagcctgtaccactgtccccccttccttggctactttgacatgtgcctgctcctggcatttcaataaaacccggcttgggtctg

SEQ ID NO: 437392 - DNA, 1565 bp, Homo sapiens
agttgttgttgaggtggcgcggcgctaagatggcggcggcggcggcggcggccgtggcgggggtggggcgcggtggcggtggcgcggagccacggcaggagcggagccgggcccggggctgggccggcgtcgaacgcagcgaaggccggaggatggaaccaggtgaggagctggaagaggagggctctccaggtggccgtgaggatggcttcaccgccgagcacctggctgcagaggccatggcagctgacatggacccctggctagtgtttgatgcccgcacaacgcctgccactgagctggatgcctggctggccaagtacccaccatcccaagttacccgctatggggaccccggttcacccaactcagagcctgtgggctggattgcagtgtatgggcagggctacagccccaactccggggacgtgcagggcctgcaggcagcctgggaagctctgcagaccagtgggcggcccatcacaccgggtaccctgcgccagctcgccatcacccaccacgtgctctcgggcaagtggcttatgcatctggcaccgggcttcaagctggaccacgcctgggctggcattgcccgggccgtggttgaaggccggcttcaggtggccaaggtgagcccacgtgccaaggagggtgggcgccaggtcatctgtgtttacacggacgacttcacggaccgcttgggtgtactggaggcggattcagccatccgtgcagcgggcattaagtgcctgctcacctacaagcctgatgtctacacctacctgggcatctaccgggccaatcgctggcacctctgccccactctctatgagagccgtttccagcttgggggtagtgcccgtggctcccgagtgcttgaccgtgccaacaacgtggaactgacctagaggggccaaattggggagactgcccactcccccctccatgctggggttggatcctcctgtcttcctccttgtcccatgaaggccacaccccccagctctggggactcctaggtcacttgggaactacctgcatcttcagtccccttgaacttctgccctctgttcagggctgacacaagccccacaggctggggggctccggttccctgagggatgagccttcagcctccctttgtaatgctgctcctctccactgcccagcaccatgagttgggtgcagacacctagaaggagagacttcttggaacgctcatcccccgctatacctccccttcctcctgcatctccccttctttccttccccctcaggagagagaaaacttagtgcttccagcccttcttggagccttcatggtccaggggtaggggccccactggcctgagcatgccattttgaggggagggtagttgtgcctacttatcccctggcagaggggatgccaggaccatggacatgaggcttgcccatccctgccaacttacacagcctgtaccactgtccccccttccttggctactttgacatgtgcctgctcctggcatttcaataaaacccggcttgggtctgtgtcttgagtgttttttaaaaaaaaaaat

SEQ ID NO: 437393 - DNA, 2028 bp, Homo sapiens
  misc_feature (1545)..(1545): n is a, c, g, or t
  misc_feature (1548)..(1548): n is a, c, g, or t
  misc_feature (1550)..(1550): n is a, c, g, or t
  misc_feature (1561)..(1561): n is a, c, g, or t
  misc_feature (1572)..(1572): n is a, c, g, or t
  misc_feature (1574)..(1575): n is a, c, g, or t
agttgttgttgaggtggcgcggcgctaagatggcggcggcggcggcggcggccgtggcgggggtggggcgcggtggcggtggcgcggagccacggcaggagcggagccgggcccggggctgggccggcgtcgaacgcagcgaaggccggaggatggaaccaggtgaggagctggaagaggagggctctccaggtggccgtgaggatggcttcaccgccgagcacctggctgcagaggccatggcagctgacatggacccctggctagtgtttgatgcccgcacaacgcctgccactgagctggatgcctggctggccaagtacccaccatcccaagttacccgctatggggaccccggttcacccaactcagagcctgtgggctggattgcagtgtatgggcagggctacagccccaactccggggacgtgcagggcctgcaggcagcctgggaagctctgcagaccagtgggcggcccatcacaccgggtaccctgcgccagctcgccatcacccaccacgtgctctcgggcaagtggcttatgcatctggcaccgggcttcaagctggaccacgcctgggctggcattgcccgggccgtggttgaaggccggcttcaggtggccaaggtgagcccacgtgccaaggagggtgggcgccaggtcatctgtgtttacacggacgacttcacggaccgcttgggtgtactggaggcggattcagccatccgtgcagcgggcattaagtgcctgctcacctacaagcctgatgtctacacctacctgggcatctaccgggccaatcgctggcacctctgccccactctctatgagagccgtttccagcttgggggtagtgcccgtggctcccgagtgcttgaccgtgccaacaacgtggaactgacctagaggggccaaattggggagactgcccactcccccctccatgctggggttggatcctcctgtcttcctccttgtcccatgaaggccacaccccccagctctggggactcctaggtcacttgggaactacctgcatcttcagtccccttgaacttctgccctctgttcagggctgacacaagccccacaggctggggggctccggttccctgagggatgagccttcagcctccctttgtaatgctgctcctctccactgcccagcaccatgagttgggtgcagacacctagaaggagagacttcttggaacgctcatcccccgctatacctccccttcctcctgcatctccccttctttccttccccctcaggagagagaaaacttagtgcttccagcccttcttggagccttcatggtccaggggtaggggccccactggcctgagcatgccattttgaggggagggtagttgtgcctacttatcccctggcagaggggatgccaggaccatggacatgaggcttgcccatccctgccaacttacacagcctgtaccactgtccccccttccttggctactttgacatgtgcctgctcctggcatttcaataaaacccggcttgggtctgaaaaaaaanaananaaaaaacaaanaaacaaaacanannaaaacaacaaagaaagcaacacaacaagaaggaaacaaaaatacacaccaaacagcaaacgcagaaaaaaaggaggggggggcaccgaaaaaaagaacacaacccgcagggaggagcaacaacatgcaagcacggaccacgacacaaactgagcagagaagacgagccgaccataaaagcgacggaagatcaacacagcaccacgcaccgaggccacacagacaacaacacggagcgacgaggcagcaaaacaacgcacacgcgaagcataaatcgcgagcaagacccccccacactcagcggtgagcaagaaagacagaaacaaccacaacacacaaaaaatagcacccgccaacacacccaacacccacaaaacgagtgctcggagcacacaaccgacggcagcgcagcacgaccacccccccacacagccacaactaacagagcgacaaa

SEQ ID NO: 437394 - DNA, 698 bp, Homo sapiens
  misc_feature (17)..(17): n is a, c, g, or t
tcagctcggtcctgccnaagcgtagtacccaactgacctagaggggccaaattggggagactgcccactcccccctccatgctggggttggatcctcctgtcttcctccttgtcccatgaaggccacaccccccagctctggggactcctaggtcacttgggaactacctgcatcttcagtccccttgaacttctgccctctgttcagggctgacacaagccccacaggctggggggctccggttccctgagggatgagccttcagcctccctttgtaatgctgctcctctccactgcccagcaccatgagttgggtgcagacacctagaaggagagacttcttggaacgctcatcccccgctatacctccccttcctcctgcatctccccttctttccttccccctcaggagagagaaaacttagtgcttccagcccttcttggagccttcatggtccaggggtaggggccccactggcctgagcatgccattttgaggggagggtagttgtgcctacttatcccctggcagaggggatgccaggaccatggacatgaggcttgcccatccctgccaacttacacagcctgtaccactgtccccccttccttggctactttgacatgtgcctgctcctggcatttcaataaaacccggcttgggtctgtgtcttgagtgttttttaaaaaaaaaaat

SEQ ID NO: 437395 - DNA, 450 bp, Homo sapiens
tagaatcgagctctgtaccgctcgataagggccaaatgcgtctccactgcccagcaccatgagttgggtgcagacacctagaaggagagacttcttggaacgctcatcccccgctatacctccccttcctcctgcatctccccttctttccttccccctcaggagagagaaaacttagtgcttccagcccttcttggagccttcatggtccaggggtaggggccccactggcctgagcatgccattttgaggggagggtagttgtgcctacttatcccctggcagaggggatgccaggaccatggacatgaggcttgcccatccctgccaacttacacagcctgtaccactgtccccccttccttggctactttgacatgtgcctgctcctggcatttcaataaaacccggcttgggtctgtgtcttgagtgttttttaaaaaaaaaaat

SEQ ID NO: 437396 - DNA, 717 bp, Homo sapiens
agttgttgttgaggtggcgcggcgctaagatggcggcggcggcggcggcggccgtggcgggggtggggcgcggtggcggtggcgcggagccacggcaggagcggagccgggcccggggctgggccggcgtcgaacgcagcgaaggccggaggatggaaccaggtgaggagctggaagaggagggctctccaggtggccgtgaggatggcttcaccgccgagcacctggctgcagaggccatggcagctgacatggacccctggctagtgtttgatgcccgcacaacgcctgccactgagctggatgcctggctggccaagtacccaccatcccaagttacccgctatggggaccccggttcacccaactcagagcctgtgggctggattgcagtgtatgggcagggctacagccccaactccggggacgtgcagggcctgcaggcagcctgggaagctctgcagaccagtgggcggcccatcacaccgggtaccctgcgccagctcgccatcacccaccacgtgctctcgggcaagtggcttatgcatctggcaccgggcttcaagctggaccacgcctgggctggcattgcccgggccgtggttgaaggccggcttcaggtggccaaggtgagcccacgtaccactgtccccccttccttggctactttgacatgtgcctgctcctggcatttcaataaaacccggcttgggtctg

SEQ ID NO: 437397 - DNA, 1530 bp, Homo sapiens
caggaacagttgttatcccattgtaaagatgaggcaactgaggcgcatcgacagtaactcttactcaaggccacagtttaatccagtgcctggcatctgtagttattgtctcagaccctgccctgactcggttccctcacagcaggatggaaccaggtgaggagctggaagaggagggctctccaggtggccgtgaggatggcttcaccgccgagcacctggctgcagaggccatggcagctgacatggacccctggctagtgtttgatgcccgcacaacgcctgccactgagctggatgcctggctggccaagtacccaccatcccaagttacccgctatggggaccccggttcacccaactcagagcctgtgggctggattgcagtgtatgggcagggctacagccccaactccggggacgtgcagggcctgcaggcagcctgggaagctctgcagaccagtgggcggcccatcacaccgggtaccctgcgccagctcgccatcacccaccacgtgctctcgggcaagtggcttatgcatctggcaccgggcttcaagctggaccacgcctgggctggcattgcccgggccgtggttgaaggccggcttcaggtggccaaggtgagcccacgtgccaaggagggtgggcgccaggtcatctgtgtttacacggacgacttcacggaccgcttgggtgtactggaggcggattcagccatccgtgcagcgggcattaagtgcctgctcacctacaagcctgatgtctacacctacctgggcatctaccgggccaatcgctggcacctctgccccactctctatgagagccgtttccagcttgggggtagtgcccgtggctcccgagtgcttgaccgtgccaacaacgtggaactgacctagaggggccaaattggggagactgcccactcccccctccatgctggggttggatcctcctgtcttcctccttgtcccatgaaggccacaccccccagctctggggactcctaggtcacttgggaactacctgcatcttcagtccccttgaacttctgccctctgttcagggctgacacaagccccacaggctggggggctccggttccctgagggatgagccttcagcctccctttgtaatgctgctcctctccactgcccagcaccatgagttgggtgcagacacctagaaggagagacttcttggaacgctcatcccccgctatacctccccttcctcctgcatctccccttctttccttccccctcaggagagagaaaacttagtgcttccagcccttcttggagccttcatggtccaggggtaggggccccactggcctgagcatgccattttgaggggagggtagttgtgcctacttatcccctggcagaggggatgccaggaccatggacatgaggcttgcccatccctgccaacttacacagcctgtaccactgtccccccttccttggctactttgacatgtgcctgctcctggcatttcaataaaacccggcttgggtctg

SEQ ID NO: 437398 - DNA, 1559 bp, Homo sapiens
caggaacagttgttatcccattgtaaagatgaggcaactgaggcgcatcgacagtaactcttactcaaggccacagtttaatccagtgcctggcatctgtagttattgtctcagaccctgccctgactcggttccctcacagcaggatggaaccaggtgaggagctggaagaggagggctctccaggtggccgtgaggatggcttcaccgccgagcacctggctgcagaggccatggcagctgacatggacccctggctagtgtttgatgcccgcacaacgcctgccactgagctggatgcctggctggccaagtacccaccatcccaagttacccgctatggggaccccggttcacccaactcagagcctgtgggctggattgcagtgtatgggcagggctacagccccaactccggggacgtgcagggcctgcaggcagcctgggaagctctgcagaccagtgggcggcccatcacaccgggtaccctgcgccagctcgccatcacccaccacgtgctctcgggcaagtggcttatgcatctggcaccgggcttcaagctggaccacgcctgggctggcattgcccgggccgtggttgaaggccggcttcaggtggccaaggtgagcccacgtgccaaggagggtgggcgccaggtcatctgtgtttacacggacgacttcacggaccgcttgggtgtactggaggcggattcagccatccgtgcagcgggcattaagtgcctgctcacctacaagcctgatgtctacacctacctgggcatctaccgggccaatcgctggcacctctgccccactctctatgagagccgtttccagcttgggggtagtgcccgtggctcccgagtgcttgaccgtgccaacaacgtggaactgacctagaggggccaaattggggagactgcccactcccccctccatgctggggttggatcctcctgtcttcctccttgtcccatgaaggccacaccccccagctctggggactcctaggtcacttgggaactacctgcatcttcagtccccttgaacttctgccctctgttcagggctgacacaagccccacaggctggggggctccggttccctgagggatgagccttcagcctccctttgtaatgctgctcctctccactgcccagcaccatgagttgggtgcagacacctagaaggagagacttcttggaacgctcatcccccgctatacctccccttcctcctgcatctccccttctttccttccccctcaggagagagaaaacttagtgcttccagcccttcttggagccttcatggtccaggggtaggggccccactggcctgagcatgccattttgaggggagggtagttgtgcctacttatcccctggcagaggggatgccaggaccatggacatgaggcttgcccatccctgccaacttacacagcctgtaccactgtccccccttccttggctactttgacatgtgcctgctcctggcatttcaataaaacccggcttgggtctgtgtcttgagtgttttttaaaaaaaaaaat

SEQ ID NO: 437399 - DNA, 925 bp, Homo sapiens
ggacgcgtgggtccggacgcgtgggtcgacccacgcggtggacgacttcacggaccgcttgggtgtactggaggcggattcagccatccgtgcagcgggcattaagtgcctgctcacctacaagcctgatgtctacacctacctgggcatctaccgggccaatcgctggcacctctgccccactctctatgagagccgtttccagcttgggggtagtgcccgtggctcccgagtgcttgaccgtgccaacaacgtggaactgacctagaggggccaaattggggagactgcccactcccccctccatgctggggttggatcctcctgtcttcctccttgtcccatgaaggccacaccccccagctctggggactcctaggtcacttgggaactacctgcatcttcagtccccttgaacttctgccctctgttcagggctgacacaagccccacaggctggggggctccggttccctgagggatgagccttcagcctccctttgtaatgctgctcctctccactgcccagcaccatgagttgggtgcagacacctagaaggagagacttcttggaacgctcatcccccgctatacctccccttcctcctgcatctccccttctttccttccccctcaggagagagaaaacttagtgcttccagcccttcttggagccttcatggtccaggggtaggggccccactggcctgagcatgccattttgaggggagggtagttgtgcctacttatcccctggcagaggggatgccaggaccatggacatgaggcttgcccatccctgccaacttacacagcctgtaccactgtccccccttccttggctactttgacatgtgcctgctcctggcatttcaataaaacccggcttgggtctgtgtcttgagtgttttttaaaaaaaaaaat

SEQ ID NO: 437400 - DNA, 138 bp, Homo sapiens
gcggccgcctactactactactgctcgaattcaagcttctaacgatgtacggggacatggctgtttaaaaaatttaatgttcaaacagttatcactgatgcttttgcactatttattaataaaatcatatattgtgta

SEQ ID NO: 437401 - DNA, 2123 bp, Homo sapiens
acctgggaagaggcggagaacaatatggcggatggcgaggagccggagaagaaaagaaggagaatagaggagctgctggctgagaaaatggctgttgatggtgggtgtggggacactggagactgggaaggtcgctggaaccatgtaaagaagttcctcgagcgatctggacccttcacacaccctgatttcgaaccgagcactgaatctctccagttcttgttagatacatgtaaagttctagtcattggagctggcggcttaggatgtgagctcctgaaaaatctggccttgtctggttttagacagattcatgttatagatatggacactatagatgtttccaatctaaataggcagtttttatttaggcctaaagatattggaagacctaaggctgaagttgctgcagaatttctaaatgacagagttcctaattgcaatgtagttccacatttcaacaagattcaagattttaacgacactttctatcgacaatttcatattattgtatgtggactggactctatcatcgccagaagatggataaatggcatgctgatatctcttctaaattatgaagatggtgtcttagatccaagctccattgtccctttgatagatggggggacagaaggttttaaaggaaatgcccgggtgattctgcctggaatgactgcttgtatcgaatgcacgctggaactttatccaccacaggttaattttcccatgtgcaccattgcatctatgcccaggctaccagaacactgtattgagtatgtaaggatgttgcagtggcctaaggagcagccttttggagaaggggttccattagatggagatgatcctgaacatatacaatggattttccaaaaatccctagagagagcatcacaatataatattaggggtgttacgtataggctcactcaaggggtagtaaaaagaatcattcctgcagtagcttccacaaatgcagtcattgcagctgtgtgtgccactgaggtttttaaaatagccacaagtgcatacattcccttgaataattacttggtgtttaatgatgtagatgggctgtatacatacacatttgaagcagaaagaaaggaaaactgcccagcttgtagccagcttcctcaaaatattcagttttctccatcagctaaactacaggaggttttggattatctaaccaatagtgcttctctgcaaatgaaatctccagccatcacagccaccctagagggaaaaaatagaacactttacttacagtcggtaacctctattgaagaacgaacaaggccaaatctctccaaaacattgaaagaattggggcttgttgatggacaagaactggcggttgctgatgtcaccaccccacagactgtactattcaaacttcattttacttcttaaggaaaatctccacataatagaaaactcatggaaataatatactttgtggatgctaagaagttgaatcgatgtcatttttagcaatagtgttgccacgatttgtctttttttatataatgaaccactcttttttaactttgtaaccttcccttgaagacagaattttggtgttggtgcttgtaagcattttcattaataatatgagaaatgatacctggagagagagattatgagcaaatgtattgcttcttttagaggaggaagcatacaacctcttttgtgtgaattttgttattatggtcaaagaatgcattcctaagttttcatttgagtacccaaatacacaaaaggtgtccctttaaggaaaataaagaattaagttttaaataacattacattttacaatctgacatctggagtatattgaacataggctatttcttgatataacactcatttaattgtggccatccaaatgaatattattgcagaatttatcttgttcataatgatttgtaaatggtgttatagctgaatacctgtgcatgaaaatgggcaatattttcatctgtttacttgtagtgccatagaggccaatatgcacaatattaactaatgccaagacatggctgtttaaaaaatttaatgttcaaacagttatcactgatgcttttgcactatttattaataaaatcatatattgtgta

SEQ ID NO: 437402 - DNA, 2081 bp, Homo sapiens
acctgggaagaggcggagaacaatatggcggatggcgaggagccaatggctgttgatggtgggtgtggggacactggagactgggaaggtcgctggaaccatgtaaagaagttcctcgagcgatctggacccttcacacaccctgatttcgaaccgagcactgaatctctccagttcttgttagatacatgtaaagttctagtcattggagctggcggcttaggatgtgagctcctgaaaaatctggccttgtctggttttagacagattcatgttatagatatggacactatagatgtttccaatctaaataggcagtttttatttaggcctaaagatattggaagacctaaggctgaagttgctgcagaatttctaaatgacagagttcctaattgcaatgtagttccacatttcaacaagattcaagattttaacgacactttctatcgacaatttcatattattgtatgtggactggactctatcatcgccagaagatggataaatggcatgctgatatctcttctaaattatgaagatggtgtcttagatccaagctccattgtccctttgatagatggggggacagaaggttttaaaggaaatgcccgggtgattctgcctggaatgactgcttgtatcgaatgcacgctggaactttatccaccacaggttaattttcccatgtgcaccattgcatctatgcccaggctaccagaacactgtattgagtatgtaaggatgttgcagtggcctaaggagcagccttttggagaaggggttccattagatggagatgatcctgaacatatacaatggattttccaaaaatccctagagagagcatcacaatataatattaggggtgttacgtataggctcactcaaggggtagtaaaaagaatcattcctgcagtagcttccacaaatgcagtcattgcagctgtgtgtgccactgaggtttttaaaatagccacaagtgcatacattcccttgaataattacttggtgtttaatgatgtagatgggctgtatacatacacatttgaagcagaaagaaaggaaaactgcccagcttgtagccagcttcctcaaaatattcagttttctccatcagctaaactacaggaggttttggattatctaaccaatagtgcttctctgcaaatgaaatctccagccatcacagccaccctagagggaaaaaatagaacactttacttacagtcggtaacctctattgaagaacgaacaaggccaaatctctccaaaacattgaaagaattggggcttgttgatggacaagaactggcggttgctgatgtcaccaccccacagactgtactattcaaacttcattttacttcttaaggaaaatctccacataatagaaaactcatggaaataatatactttgtggatgctaagaagttgaatcgatgtcatttttagcaatagtgttgccacgatttgtctttttttatataatgaaccactcttttttaactttgtaaccttcccttgaagacagaattttggtgttggtgcttgtaagcattttcattaataatatgagaaatgatacctggagagagagattatgagcaaatgtattgcttcttttagaggaggaagcatacaacctcttttgtgtgaattttgttattatggtcaaagaatgcattcctaagttttcatttgagtacccaaatacacaaaaggtgtccctttaaggaaaataaagaattaagttttaaataacattacattttacaatctgacatctggagtatattgaacataggctatttcttgatataacactcatttaattgtggccatccaaatgaatattattgcagaatttatcttgttcataatgatttgtaaatggtgttatagctgaatacctgtgcatgaaaatgggcaatattttcatctgtttacttgtagtgccatagaggccaatatgcacaatattaactaatgccaagacatggctgtttaaaaaatttaatgttcaaacagttatcactgatgcttttgcactatttattaataaaatcatatattgtgta

SEQ ID NO: 437403 - DNA, 745 bp, Homo sapiens
  misc_feature (712)..(712): n is a, c, g, or t
  misc_feature (728)..(728): n is a, c, g, or t
acctgggaagaggcggagaacaatatggcggatggcgaggagccggagaagaaaagaaggagaatagaggagctgctggctgagaaaatggctgttgatggtgggtgtggggacactggagactgggaaggtcgctggaaccatgtaaagaagttcctcgagcgatctggacccttcacacaccctgatttcgaaccgagcactgaatctctccagttcttgttagatacatgtaaagttctagtcattggagctggcggcttaggatgtgagctcctgaaaaatctgactatagatgtttccaatctaaataggcagtttttatttaggcctaaagatattggaagacctaaggctgaagttgctgcagaatttctaaatgacagagttcctaattgcaatgtagttccacatttcaacaagattcaagattttaacgacactttctatcgacaatttcatattattgtatgtggactggactctatcatcgccagaagatggataaatggcatgctgatatctcttctaaattatgaagatggtgtcttagatccaagctccattgtccctttgatagatggggggacagaaggttttaaaggaaatgcccgggtgattctgcctggaatgactgcttgtatcgaatgcacgctggaactttatccaccacaggtaatttccatgtgaccattgattattccagcttccnacactgattagagttncgatgtggggccgtcct

SEQ ID NO: 437404 - DNA, 929 bp, Homo sapiens
cagtgttttttttgtaaataccaaatgtagagaagtcaatttctcacataatagaccaatatcctaagttgaaccttggattgctttaggaaaccaaaaacatgtagactgatttatttcatccattgggtgaaataaaaatagaaacgtgcagttcttaactttaaatgaattgtataataggcaagaaaaaatttcaaagcataaacataatcacattgaatattttcctttttatttgagcaggtctggtgtggttaccttttcatttggggataccataatagttgtaggtgtggtttttttcatactgatctttgcagctgaatttactgtgttctgtgcagaatggctgttgatggtgggtgtggggacactggagactgggaaggtcgctggaaccatgtaaagaagttcctcgagcgatctggacccttcacacaccctgatttcgaaccgagcactgaaagtgagaaacgtttatttttaaataactgctctaatagttttatgtttcaaaactaatagaatgcttcttttttaatttgctcttacaatgaaaatactaataaaattgttttgtgaaactaaatttttcttaaaatatgagattgaatattcacaactgattttgtttgaatatttgagtcttaacatttctcatgtaatataagttgaaaatttttgtgagaaaaatctaacttcatgacctcatgtaaaaatttaaaatgctttctgaaacatactccccttttgtagtgctactgtgagaaattaattttgataggagtataggtgtgcttacttaaattttgaaatttagttggaatgaacatcttagctttgagtataattaattgcatgttaagaattatgtaagtactaaataatagaggcgtagaatttggactgatagtgtctatcttaag

SEQ ID NO: 437405 - DNA, 668 bp, Homo sapiens
  misc_feature (613)..(613): n is a, c, g, or t
cagtgttttttttgtaaataccaaatgtagagaagtcaatttctcacataatagaccaatatcctaagttgaaccttggattgctttaggaaaccaaaaacatgtagactgatttatttcatccattgggtgaaataaaaatagaaacgtgcagttcttaactttaaatgaattgtataataggcaagaaaaaatttcaaagcataaacataatcacattgaatattttcctttttatttgagcaggtctggtgtggttaccttttcatttggggataccataatagttgtaggtgtggtttttttcatactgatctttgcagctgaatttactgtgttctgtgcagaatggctgttgatggtgggtgtggggacactggagactgggaaggtcgctggaaccatgtaaagaagttcctcgagcgatctggacccttcacacaccctgatttcgaaccgagcactgaagtcgatagaaagtgtcgttaaaatcttgaatcttgttgaaatgtggaactacattgcaattaggaactctgtcatttagaaattctgcagcaacttcagccttaggtcttccaatatctttaggcctaaataaaaactgcctatntagattggaaacatctatagtgtccatatctataacatgaatctgtctaaaacca

SEQ ID NO: 437406 - DNA, 454 bp, Homo sapiens
acctgggaagaggcggagaacaatatggcggatggcgaggagccggagaagaaaagaaggagaatagaggagctgctggctgagaagttagtgctgccgggaggccggggccctctccggggacccccgcctccccccaccccaggcctaggggaccagccgcagcgggcccggggggctgggagggggacacccggagcgcaggccgcgctgcctcatcccctgatccccgccccgcagccccgggggcctggcgggccgctcccggtatctgcccggtgcgggcgtcggggccaggctgtactgccccagctcctgcaggggccctccggggtgcttgacgtaaaggtcttgaggaaggacccttgtgcactcctcttcctccatcccaaattgtcagagcagtgaccctgtgaaaaggcaatctaccttaaacacacaggaaaaggacaca

SEQ ID NO: 437407 - DNA, 2079 bp, Homo sapiens
acctgggaagaggcggagaacaatatggcggatggcgaggagccggagaagaaaagaaggagaatagaggagctgctggctgagaaaatggctgttgatggtgggtgtggggacactggagactgggaaggtcgctggaaccatgtaaagaagttcctcgagcgatctggacccttcacacaccctgatttcgaaccgagcactgaatctctccagttcttgttagatacatgtaaagttctagtcattggagctggcggcttaggatgtgagctcctgaaaaatctggccttgtctggttttagacagattcatgttatagatatggacactatagatgtttccaatctaaataggcagtttttatttaggcctaaagatattggaagacctaaggctgaagttgctgcagaatttctaaatgacagagttcctaattgcaatgtagttccacatttcaacaagattcaagattttaacgacactttctatcgacaatttcatattattgtatgtggactggactctatcatcgccagaagatggataaatggcatgctgatatctcttctaaattatgaagatggtgtcttagatccaagctccattgtccctttgatagatggggggacagaaggttttaaaggaaatgcccgggtgattctgcctggaatgactgcttgtatcgaatgcacgctggaactttatccaccacaggttaattttcccatgtgcaccattgcatctatgcccaggctaccagaacactgtattgagtatgtaaggatgttgcagtggcctaaggagcagccttttggagaaggggttccattagatggagatgatcctgaacatatacaatggattttccaaaaatccctagagagagcatcacaatataatattaggggtgttacgtataggctcactcaaggggtagtaaaaagaatcattcctgcagtagcttccacaaatgcagtcattgcagctgtgtgtgccactgaggtttttaaaatagccacaagatgggctgtatacatacacatttgaagcagaaagaaaggaaaactgcccagcttgtagccagcttcctcaaaatattcagttttctccatcagctaaactacaggaggttttggattatctaaccaatagtgcttctctgcaaatgaaatctccagccatcacagccaccctagagggaaaaaatagaacactttacttacagtcggtaacctctattgaagaacgaacaaggccaaatctctccaaaacattgaaagaattggggcttgttgatggacaagaactggcggttgctgatgtcaccaccccacagactgtactattcaaacttcattttacttcttaaggaaaatctccacataatagaaaactcatggaaataatatactttgtggatgctaagaagttgaatcgatgtcatttttagcaatagtgttgccacgatttgtctttttttatataatgaaccactcttttttaactttgtaaccttcccttgaagacagaattttggtgttggtgcttgtaagcattttcattaataatatgagaaatgatacctggagagagagattatgagcaaatgtattgcttcttttagaggaggaagcatacaacctcttttgtgtgaattttgttattatggtcaaagaatgcattcctaagttttcatttgagtacccaaatacacaaaaggtgtccctttaaggaaaataaagaattaagttttaaataacattacattttacaatctgacatctggagtatattgaacataggctatttcttgatataacactcatttaattgtggccatccaaatgaatattattgcagaatttatcttgttcataatgatttgtaaatggtgttatagctgaatacctgtgcatgaaaatgggcaatattttcatctgtttacttgtagtgccatagaggccaatatgcacaatattaactaatgccaagacatggctgtttaaaaaatttaatgttcaaacagttatcactgatgcttttgcactatttattaataaaatcatatattgtgta

SEQ ID NO: 437408 - DNA, 2042 bp, Homo sapiens
acctgggaagaggcggagaacaatatggcggatggcgaggagccggagaagaaaagaaggagaatagaggagctgctggctgagaaaatggctgttgatggtgggtgtggggacactggagactgggaaggtcgctggaaccatgtaaagaagttcctcgagcgatctggacccttcacacaccctgatttcgaaccgagcactgaagccttgtctggttttagacagattcatgttatagatatggacactatagatgtttccaatctaaataggcagtttttatttaggcctaaagatattggaagacctaaggctgaagttgctgcagaatttctaaatgacagagttcctaattgcaatgtagttccacatttcaacaagattcaagattttaacgacactttctatcgacaatttcatattattgtatgtggactggactctatcatcgccagaagatggataaatggcatgctgatatctcttctaaattatgaagatggtgtcttagatccaagctccattgtccctttgatagatggggggacagaaggttttaaaggaaatgcccgggtgattctgcctggaatgactgcttgtatcgaatgcacgctggaactttatccaccacaggttaattttcccatgtgcaccattgcatctatgcccaggctaccagaacactgtattgagtatgtaaggatgttgcagtggcctaaggagcagccttttggagaaggggttccattagatggagatgatcctgaacatatacaatggattttccaaaaatccctagagagagcatcacaatataatattaggggtgttacgtataggctcactcaaggggtagtaaaaagaatcattcctgcagtagcttccacaaatgcagtcattgcagctgtgtgtgccactgaggtttttaaaatagccacaagtgcatacattcccttgaataattacttggtgtttaatgatgtagatgggctgtatacatacacatttgaagcagaaagaaaggaaaactgcccagcttgtagccagcttcctcaaaatattcagttttctccatcagctaaactacaggaggttttggattatctaaccaatagtgcttctctgcaaatgaaatctccagccatcacagccaccctagagggaaaaaatagaacactttacttacagtcggtaacctctattgaagaacgaacaaggccaaatctctccaaaacattgaaagaattggggcttgttgatggacaagaactggcggttgctgatgtcaccaccccacagactgtactattcaaacttcattttacttcttaaggaaaatctccacataatagaaaactcatggaaataatatactttgtggatgctaagaagttgaatcgatgtcatttttagcaatagtgttgccacgatttgtctttttttatataatgaaccactcttttttaactttgtaaccttcccttgaagacagaattttggtgttggtgcttgtaagcattttcattaataatatgagaaatgatacctggagagagagattatgagcaaatgtattgcttcttttagaggaggaagcatacaacctcttttgtgtgaattttgttattatggtcaaagaatgcattcctaagttttcatttgagtacccaaatacacaaaaggtgtccctttaaggaaaataaagaattaagttttaaataacattacattttacaatctgacatctggagtatattgaacataggctatttcttgatataacactcatttaattgtggccatccaaatgaatattattgcagaatttatcttgttcataatgatttgtaaatggtgttatagctgaatacctgtgcatgaaaatgggcaatattttcatctgtttacttgtagtgccatagaggccaatatgcacaatattaactaatgccaagacatggctgtttaaaaaatttaatgttcaaacagttatcactgatgcttttgcactatttattaataaaatcatatattgtgta

SEQ ID NO: 437409 - DNA, 2081 bp, Homo sapiens
acctgggaagaggcggagaacaatatggcggatggcgaggagccggagaagaaaagaaggagaatagaggagctgctggctgagaaaatggctgttgatggtgggtgtggggacactggagactgggaaggtcgctggaaccatgtaaagaagttcctcgagcgatctggacccttcacacaccctgatttcgaaccgagcactgaatctctccagttcttgttagatacatgtaaagttctagtcattggagctggcggcttaggatgtgagctcctgaaaaatctgactatagatgtttccaatctaaataggcagtttttatttaggcctaaagatattggaagacctaaggctgaagttgctgcagaatttctaaatgacagagttcctaattgcaatgtagttccacatttcaacaagattcaagattttaacgacactttctatcgacaatttcatattattgtatgtggactggactctatcatcgccagaagatggataaatggcatgctgatatctcttctaaattatgaagatggtgtcttagatccaagctccattgtccctttgatagatggggggacagaaggttttaaaggaaatgcccgggtgattctgcctggaatgactgcttgtatcgaatgcacgctggaactttatccaccacaggttaattttcccatgtgcaccattgcatctatgcccaggctaccagaacactgtattgagtatgtaaggatgttgcagtggcctaaggagcagccttttggagaaggggttccattagatggagatgatcctgaacatatacaatggattttccaaaaatccctagagagagcatcacaatataatattaggggtgttacgtataggctcactcaaggggtagtaaaaagaatcattcctgcagtagcttccacaaatgcagtcattgcagctgtgtgtgccactgaggtttttaaaatagccacaagtgcatacattcccttgaataattacttggtgtttaatgatgtagatgggctgtatacatacacatttgaagcagaaagaaaggaaaactgcccagcttgtagccagcttcctcaaaatattcagttttctccatcagctaaactacaggaggttttggattatctaaccaatagtgcttctctgcaaatgaaatctccagccatcacagccaccctagagggaaaaaatagaacactttacttacagtcggtaacctctattgaagaacgaacaaggccaaatctctccaaaacattgaaagaattggggcttgttgatggacaagaactggcggttgctgatgtcaccaccccacagactgtactattcaaacttcattttacttcttaaggaaaatctccacataatagaaaactcatggaaataatatactttgtggatgctaagaagttgaatcgatgtcatttttagcaatagtgttgccacgatttgtctttttttatataatgaaccactcttttttaactttgtaaccttcccttgaagacagaattttggtgttggtgcttgtaagcattttcattaataatatgagaaatgatacctggagagagagattatgagcaaatgtattgcttcttttagaggaggaagcatacaacctcttttgtgtgaattttgttattatggtcaaagaatgcattcctaagttttcatttgagtacccaaatacacaaaaggtgtccctttaaggaaaataaagaattaagttttaaataacattacattttacaatctgacatctggagtatattgaacataggctatttcttgatataacactcatttaattgtggccatccaaatgaatattattgcagaatttatcttgttcataatgatttgtaaatggtgttatagctgaatacctgtgcatgaaaatgggcaatattttcatctgtttacttgtagtgccatagaggccaatatgcacaatattaactaatgccaagacatggctgtttaaaaaatttaatgttcaaacagttatcactgatgcttttgcactatttattaataaaatcatatattgtgta

SEQ ID NO: 437410 - DNA, 2079 bp, Homo sapiens
acctgggaagaggcggagaacaatatggcggatggcgaggagccggagaagaaaagaaggagaatagaggagctgctggctgagaaaatggctgttgatggtgggtgtggggacactggagactgggaaggtcgctggaaccatgtaaagaagttcctcgagcgatctggacccttcacacaccctgatttcgaaccgagcactgaatctctccagttcttgttagatacatgtaaagttctagtcattggagctggcggcttaggatgtgagctcctgaaaaatctggccttgtctggttttagacagattcatgttatagatatggacactatagatgtttccaatctaaataggcagtttttatttaggcctaaagatattggaagacctaaggctgaagttgctgcagaatttctaaatgacagagttcctaattgcaatgtagttccaatttcatattattgtatgtggactggactctatcatcgccagaagatggataaatggcatgctgatatctcttctaaattatgaagatggtgtcttagatccaagctccattgtccctttgatagatggggggacagaaggttttaaaggaaatgcccgggtgattctgcctggaatgactgcttgtatcgaatgcacgctggaactttatccaccacaggttaattttcccatgtgcaccattgcatctatgcccaggctaccagaacactgtattgagtatgtaaggatgttgcagtggcctaaggagcagccttttggagaaggggttccattagatggagatgatcctgaacatatacaatggattttccaaaaatccctagagagagcatcacaatataatattaggggtgttacgtataggctcactcaaggggtagtaaaaagaatcattcctgcagtagcttccacaaatgcagtcattgcagctgtgtgtgccactgaggtttttaaaatagccacaagtgcatacattcccttgaataattacttggtgtttaatgatgtagatgggctgtatacatacacatttgaagcagaaagaaaggaaaactgcccagcttgtagccagcttcctcaaaatattcagttttctccatcagctaaactacaggaggttttggattatctaaccaatagtgcttctctgcaaatgaaatctccagccatcacagccaccctagagggaaaaaatagaacactttacttacagtcggtaacctctattgaagaacgaacaaggccaaatctctccaaaacattgaaagaattggggcttgttgatggacaagaactggcggttgctgatgtcaccaccccacagactgtactattcaaacttcattttacttcttaaggaaaatctccacataatagaaaactcatggaaataatatactttgtggatgctaagaagttgaatcgatgtcatttttagcaatagtgttgccacgatttgtctttttttatataatgaaccactcttttttaactttgtaaccttcccttgaagacagaattttggtgttggtgcttgtaagcattttcattaataatatgagaaatgatacctggagagagagattatgagcaaatgtattgcttcttttagaggaggaagcatacaacctcttttgtgtgaattttgttattatggtcaaagaatgcattcctaagttttcatttgagtacccaaatacacaaaaggtgtccctttaaggaaaataaagaattaagttttaaataacattacattttacaatctgacatctggagtatattgaacataggctatttcttgatataacactcatttaattgtggccatccaaatgaatattattgcagaatttatcttgttcataatgatttgtaaatggtgttatagctgaatacctgtgcatgaaaatgggcaatattttcatctgtttacttgtagtgccatagaggccaatatgcacaatattaactaatgccaagacatggctgtttaaaaaatttaatgttcaaacagttatcactgatgcttttgcactatttattaataaaatcatatattgtgta

SEQ ID NO: 437411 - DNA, 1733 bp, Homo sapiens
acctgggaagaggcggagaacaatatggcggatggcgaggagccggagaagaaaagaaggagaatagaggagctgctggctgagaaaatggctgttgatggtgggtgtggggacactggagactgggaaggtcgctggaaccatgtaaagaagttcctcgagcgatctggacccttcacacaccctgatttcgaaccgagcactgaatctctccagttcttgttagatacatgtaaagttctagtcattggagctggcggcttaggatgtgagctcctgaaaaatctggccttgtctggttttagacagattcatgttatagatatggacactatagatgtttccaatctaaataggcagtttttatttaggcctaaagatattggaagacctaaggctgaagttgctgcagaatttctaaatgacagagttcctaattgcaatgtagttccacatttcaacaagattcaagattttaacgacactttctatcgacaatttcatattattgtatgtggactggactctatcatcgccagaagatggataaatggcatgctgatatctcttctaaattatgaagatggtgtcttagatccaagctccattgtccctttgatagatggggggacagaaggttttaaaggaaatgcccgggtgattctgcctggaatgactgcttgtatcgaatgcacgctggaactttatccaccacaggttaattttcccatgtgcaccattgcatctatgcccaggctaccagaacactgtattgagtatgtaaggatgttgcagtggcctaaggagcagccttttggagaaggggttccattagatggagatgatcctgaacatatacaatggattttccaaaaatccctagagagagcatcacaatataatattaggggtgttacgtataggctcactcaaggggtagtaaaaagaatcattcctgcagtagcttccacaaatgcagtcattgcagctgtgtgtgccactgaggtttttaaaatagccacaagtgcatacattcccttgaataattacttggtgtttaatgatgtagatgggctgtatacatacacatttgaagcagaaagaaaggaaaactgcccagcttgtagccagcttcctcaaaatattcagttttctccatcagctaaactacaggaggttttggattatctaaccaatagtgcttctctgcaaatgaaatctccagccatcacagccaccctagagggaaaaaatagaacactttacttacagtcggtaacctctattgaagaacgaacaaggccaaatctctccaaaacattgaaagaattggggcttgttgatggacaagaactggcggttgctgatgtcaccaccccacagactgtactattcaaacttcattttacttcttaaggaaaatctccacataatagaaaactcatggaaataatatactttgtggatgctaagaagttgaatcgatgtcatttttagcaatagtgttgccacgatttgtctttttttatataatgaaccactcttttttaactttgtaaccttcccttgaagacagaattttggtgttggtgcttgtaagcattttcattaataatatgagaaatgatacctgatgggagaaagactggcgcatcttctcccatcagccacgtcttggactgctgttttgataaccaacaagaggtcaatgtatagaaatccgctgatgggcc

SEQ ID NO: 437412 - DNA, 905 bp, Homo sapiens
aaaccccacatcaccccccccacctccgaccgacaaaaaaaaaagaagccttagtcggtaacctctattgaagaacgaacaaggccaaatctctccaaaacattgaaagaattggggcttgttgatggacaagaactggcggttgctgatgtcaccaccccacagactgtactattcaaacttcattttacttcttaaggaaaatctccacataatagaaaactcatggaaataatatactttgtggatgctaagaagttgaatcgatgtcatttttagcaatagtgttgccacgatttgtctttttttatataatgaaccactcttttttaactttgtaaccttcccttgaagacagaattttggtgttggtgcttgtaagcattttcattaataatatgagaaatgatacctggagagagagattatgagcaaatgtattgcttcttttagaggaggaagcatacaacctcttttgtgtgaattttgttattatggtcaaagaatgcattcctaagttttcatttgagtacccaaatacacaaaaggtgtccctttaaggaaaataaagaattaagttttaaataacattacattttacaatctgacatctggagtatattgaacataggctatttcttgatataacactcatttaattgtggccatccaaatgaatattattgcagaatttatcttgttcataatgatttgtaaatggtgttatagctgaatacctgtgcatgaaaatgggcaatattttcatctgtttacttgtagtgccatagaggccaatatgcacaatattaactaatgccaagacatggctgtttaaaaaatttaatgttcaaacagttatcactgatgcttttgcactatttattaataaaatcatatattgtgta

SEQ ID NO: 437413 - DNA, 1157 bp, Homo sapiens
acctgggaagaggcggagaacaatatggcggatggcgaggagccggagaagaaaagaaggagaatagaggagctgctggctgagaaaatggctgttgatggtgggtgtggggacactggagactgggaaggtcgctggaaccatgtaaagaagttcctcgagcgatctggacccttcacacaccctgatttcgaaccgagcactgaatctctccagttcttgttagatacatgtaaagttctagtcattggagctggcggcttaggatgtgagctcctgaaaaatctggccttgtctggttttagacagattcatgttatagatatggacactatagatgtttccaatctaaataggcagtttttatttaggcctaaagatattggaagacctaaggctgaagttgctgcagaatttctaaatgacagagttcctaattgcaatgtagttccacatttcaacaagattcaagattttaacgacactttctatcgacaatttcatattattgtatgtggactggactctatcatcgccagaagatggataaatggcatgctgatatctcttctaaattatgaagatggtgtcttagatccaagctccattgtccctttgatagatggggggacagaaggttttaaaggaaatgcccgggtgattctgcctggaatgactgcttgtatcgaatgcacgctggaactttatccaccacaggttaattttcccatgtgcaccattgcatctatgcccaggctaccagaacactgtattgagtatgtaaggatgttgcagtggcctaaggagcagccttttggagaaggggttccattagatggagatgatcctgaacatatacaatggattttccaaaaatccctagagagagcatcacaatataatattaggggtgttacgtataggctcactcaaggggtagtaaaaagaatcattcctgcagtagcttccacaaatgcagtcattgcagctgtggtgtgccactgaggtttttaaaataggccaaaagtggcatttcatttccttggaaataattacttgggggtgtacggacggtcaaagggggcggtgtaccctcaccccctttgcgggcccaaaacaaaggggaacgggcccacttgttatcgggtcccacaaat

SEQ ID NO: 437414 - DNA, 993 bp, Homo sapiens
acctgggaagaggcggagaacaatatggcggatggcgaggagccggagaagaaaagaaggagaatagaggagctgctggctgagaaaatggctgttgatggtgggtgtggggacactggagactgggaaggtcgctggaaccatgtaaagaagttcctcgagcgatctggacccttcacacaccctgatttcgaaccgagcactgaatctctccagttcttgttagatacatgtaaagttctagtcattggagctggcggcttaggatgtgagctcctgaaaaatctggccttgtctggttttagacagattcatgttatagatatggacactatagatgtttccaatctaaataggcagtttttatttaggcctaaagatattggaagacctaaggctgaagttgctgcagaatttctaaatgacagagttcctaattgcaatgtagttccacatttcaacaagattcaagattttaacgacactttctatcgacaatttcatattattgtatgtggactggactctatcatcgccagaagatggataaatggcatgctgatatctcttctaaattatgaagatggtgtcttagatccaagctccattgtccctttgatagatggggggacagaaggttttaaaggaaatgcccgggtgattctgcctggaatgactgcttgtatcgaatgcacgctggaactttatccaccacaggttaattttcccatgtgcaccattgcatctatgcccaggctaccagaacactgtattgagtatgtaaggatgttgcagtggcctaaggagcagccttttggagaaagggggtaccattagatctggcgcatgatcctgaaaaatattaaaaggggatttacaaaaaatccctagagagaagaatcaagacacataactataaggggaggtaacagtaataggggtcactcacaggaggtcagtaaaaaaagaatacataacggcgtaagattcccc

SEQ ID NO: 437415 - DNA, 119 bp, Homo sapiens
gtaagtattgtagatttttgttatgttgtaaaaatcatttttgtgatttttgaaaccttaaaaaaattatcttttgataaaaattatgtttgatacttctctctcatcataatctttag

SEQ ID NO: 437416 - DNA, 217 bp, Homo sapiens
taatttaagagaactcttttattttaaagaaatgaccatattttaattgatatgttttttcaggggtagtaaaaagaatcattcctgcagtagcttccacaaatgcagtcattgcaggtgaggaagaaaaggccatcacttagtttattttgctttctttagtttttgacgttgctgcagcttttttgtgttgtaggaatttgatatcttcttggat

SEQ ID NO: 437417 - DNA, 2120 bp, Homo sapiens
ctacgtttccagtgacctgacagcagaggaggggaggagccggagaagaaaagaaggagaatagaggagctgctggctgagaaaatggctgttgatggtgggtgtggggacactggagactgggaaggtcgctggaaccatgtaaagaagttcctcgagcgatctggacccttcacacaccctgatttcgaaccgagcactgaatctctccagttcttgttagatacatgtaaagttctagtcattggagctggcggcttaggatgtgagctcctgaaaaatctggccttgtctggttttagacagattcatgttatagatatggacactatagatgtttccaatctaaataggcagtttttatttaggcctaaagatattggaagacctaaggctgaagttgctgcagaatttctaaatgacagagttcctaattgcaatgtagttccacatttcaacaagattcaagattttaacgacactttctatcgacaatttcatattattgtatgtggactggactctatcatcgccagaagatggataaatggcatgctgatatctcttctaaattatgaagatggtgtcttagatccaagctccattgtccctttgatagatggggggacagaaggttttaaaggaaatgcccgggtgattctgcctggaatgactgcttgtatcgaatgcacgctggaactttatccaccacaggttaattttcccatgtgcaccattgcatctatgcccaggctaccagaacactgtattgagtatgtaaggatgttgcagtggcctaaggagcagccttttggagaaggggttccattagatggagatgatcctgaacatatacaatggattttccaaaaatccctagagagagcatcacaatataatattaggggtgttacgtataggctcactcaaggggtagtaaaaagaatcattcctgcagtagcttccacaaatgcagtcattgcagctgtgtgtgccactgaggtttttaaaatagccacaagtgcatacattcccttgaataattacttggtgtttaatgatgtagatgggctgtatacatacacatttgaagcagaaagaaaggaaaactgcccagcttgtagccagcttcctcaaaatattcagttttctccatcagctaaactacaggaggttttggattatctaaccaatagtgcttctctgcaaatgaaatctccagccatcacagccaccctagagggaaaaaatagaacactttacttacagtcggtaacctctattgaagaacgaacaaggccaaatctctccaaaacattgaaagaattggggcttgttgatggacaagaactggcggttgctgatgtcaccaccccacagactgtactattcaaacttcattttacttcttaaggaaaatctccacataatagaaaactcatggaaataatatactttgtggatgctaagaagttgaatcgatgtcatttttagcaatagtgttgccacgatttgtctttttttatataatgaaccactcttttttaactttgtaaccttcccttgaagacagaattttggtgttggtgcttgtaagcattttcattaataatatgagaaatgatacctggagagagagattatgagcaaatgtattgcttcttttagaggaggaagcatacaacctcttttgtgtgaattttgttattatggtcaaagaatgcattcctaagttttcatttgagtacccaaatacacaaaaggtgtccctttaaggaaaataaagaattaagttttaaataacattacattttacaatctgacatctggagtatattgaacataggctatttcttgatataacactcatttaattgtggccatccaaatgaatattattgcagaatttatcttgttcataatgatttgtaaatggtgttatagctgaatacctgtgcatgaaaatgggcaatattttcatctgtttacttgtagtgccatagaggccaatatgcacaatattaactaatgccaagacatggctgtttaaaaaatttaatgttcaaacagttatcactgatgcttttgcactatttattaataaaatcatatattgtgta

SEQ ID NO: 437418 - DNA, 668 bp, Homo sapiens
acctgggaagaggcggagaacaatatggcggatggcgaggagccggagaagaaaagaaggagaatagaggagctgctggctgagaaaatggctgttgatggtgggtgtggggacactggagactgggaaggtcgctggaaccatgtaaagaagttcctcgagcgatctggacccttcacacaccctgatttcgaaccgagcactgaaagtgagaaacgtttatttttaaataactgctctaatagttttatgtttcaaaactaatagaatgcttcttttttaatttgctcttacaatgaaaatactaataaaattgttttgtgaaactaaatttttcttaaaatatgagattgaatattcacaactgattttgtttgaatatttgagtcttaacatttctcatgtaatataagttgaaaatttttgtgagaaaaatctaacttcatgacctcatgtaaaaatttaaaatgctttctgaaacatactccccttttgtagtgctactgtgagaaattaattttgataggagtataggtgtgcttacttaaattttgaaatttagttggaatgaacatcttagctttgagtataattaattgcatgttaagaattatgtaagtactaaataatagaggcgtagaatttggactgatagtgtctatcttaag

SEQ ID NO: 437419 - DNA, 2144 bp, Homo sapiens
  misc_feature (2140)..(2140): n is a, c, g, or t
acctgggaagaggcggagaacaatatggcggatggcgaggagccggagaagaaaagaaggagaatagaggagctgctggctgagaaaatggctgttgatggtgggtgtggggacactggagactgggaaggtcgctggaaccatgtaaagaagttcctcgagcgatctggacccttcacacaccctgatttcgaaccgagcactgaatctctccagttcttgttagatacatgtaaagttctagtcattggagctggcggcttaggatgtgagctcctgaaaaatctggccttgtctggttttagacagattcatgttatagatatggacactatagatgtttccaatctaaataggcagtttttatttaggcctaaagatattggaagacctaaggctgaagttgctgcagaatttctaaatgacagagttcctaattgcaatgtagttccacatttcaacaagattcaagattttaacgacactttctatcgacaatttcatattattgtatgtggactggactctatcatcgccagaagatggataaatggcatgctgatatctcttctaaattatgaagatggtgtcttagatccaagctccattgtccctttgatagatggggggacagaaggttttaaaggaaatgcccgggtgattctgcctggaatgactgcttgtatcgaatgcacgctggaactttatccaccacaggttaattttcccatgtgcaccattgcatctatgcccaggctaccagaacactgtattgagtatgtaaggatgttgcagtggcctaaggagcagccttttggagaaggggttccattagatggagatgatcctgaacatatacaatggattttccaaaaatccctagagagagcatcacaatataatattaggggtgttacgtataggctcactcaaggggtagtaaaaagaatcattcctgcagtagcttccacaaatgcagtcattgcagctgtgtgtgccactgaggtttttaaaatagccacaagtgcatacattcccttgaataattacttggtgtttaatgatgtagatgggctgtatacatacacatttgaagcagaaagaaaggaaaactgcccagcttgtagccagcttcctcaaaatattcagttttctccatcagctaaactacaggaggttttggattatctaaccaatagtgcttctctgcaaatgaaatctccagccatcacagccaccctagagggaaaaaatagaacactttacttacagtcggtaacctctattgaagaacgaacaaggccaaatctctccaaaacattgaaagaattggggcttgttgatggacaagaactggcggttgctgatgtcaccaccccacagactgtactattcaaacttcattttacttcttaaggaaaatctccacataatagaaaactcatggaaataatatactttgtggatgctaagaagttgaatcgatgtcatttttagcaatagtgttgccacgatttgtctttttttatataatgaaccactcttttttaactttgtaaccttcccttgaagacagaattttggtgttggtgcttgtaagcattttcattaataatatgagaaatgatacctggagagagagattatgagcaaatgtattgcttcttttagaggaggaagcatacaacctcttttgtgtgaattttgttattatggtcaaagaatgcattcctaagttttcatttgagtacccaaatacacaaaaggtgtccctttaaggaaaataaagaattaagttttaaataacattacattttacaatctgacatctggagtatattgaacataggctatttcttgatataacactcatttaattgtggccatccaaatgaatattattgcagaatttatcttgttcataatgatttgtaaatggtgttatagctgaatacctgtgcatgaaaatgggcaatattttcatctgtttacttgtagtgccatagaggccaatatgcacaatattaactaatgccaagacatggctgtttaaaaaatttaatgttcccccggttatgggtggcgcattcacccttttttaaaaaaacctacccaattgtgtaaaaaaaaattgtaatgnggag

SEQ ID NO: 437420 - DNA, 2002 bp, Homo sapiens
acctgggaagaggcggagaacaatatggcggatggcgaggagccggagaagaaaagaaggagaatagaggagctgctggctgagaatctctccagttcttgttagatacatgtaaagttctagtcattggagctggcggcttaggatgtgagctcctgaaaaatctggccttgtctggttttagacagattcatgttatagatatggacactatagatgtttccaatctaaataggcagtttttatttaggcctaaagatattggaagacctaaggctgaagttgctgcagaatttctaaatgacagagttcctaattgcaatgtagttccacatttcaacaagattcaagattttaacgacactttctatcgacaatttcatattattgtatgtggactggactctatcatcgccagaagatggataaatggcatgctgatatctcttctaaattatgaagatggtgtcttagatccaagctccattgtccctttgatagatggggggacagaaggttttaaaggaaatgcccgggtgattctgcctggaatgactgcttgtatcgaatgcacgctggaactttatccaccacaggttaattttcccatgtgcaccattgcatctatgcccaggctaccagaacactgtattgagtatgtaaggatgttgcagtggcctaaggagcagccttttggagaaggggttccattagatggagatgatcctgaacatatacaatggattttccaaaaatccctagagagagcatcacaatataatattaggggtgttacgtataggctcactcaaggggtagtaaaaagaatcattcctgcagtagcttccacaaatgcagtcattgcagctgtgtgtgccactgaggtttttaaaatagccacaagtgcatacattcccttgaataattacttggtgtttaatgatgtagatgggctgtatacatacacatttgaagcagaaagaaaggaaaactgcccagcttgtagccagcttcctcaaaatattcagttttctccatcagctaaactacaggaggttttggattatctaaccaatagtgcttctctgcaaatgaaatctccagccatcacagccaccctagagggaaaaaatagaacactttacttacagtcggtaacctctattgaagaacgaacaaggccaaatctctccaaaacattgaaagaattggggcttgttgatggacaagaactggcggttgctgatgtcaccaccccacagactgtactattcaaacttcattttacttcttaaggaaaatctccacataatagaaaactcatggaaataatatactttgtggatgctaagaagttgaatcgatgtcatttttagcaatagtgttgccacgatttgtctttttttatataatgaaccactcttttttaactttgtaaccttcccttgaagacagaattttggtgttggtgcttgtaagcattttcattaataatatgagaaatgatacctggagagagagattatgagcaaatgtattgcttcttttagaggaggaagcatacaacctcttttgtgtgaattttgttattatggtcaaagaatgcattcctaagttttcatttgagtacccaaatacacaaaaggtgtccctttaaggaaaataaagaattaagttttaaataacattacattttacaatctgacatctggagtatattgaacataggctatttcttgatataacactcatttaattgtggccatccaaatgaatattattgcagaatttatcttgttcataatgatttgtaaatggtgttatagctgaatacctgtgcatgaaaatgggcaatattttcatctgtttacttgtagtgccatagaggccaatatgcacaatattaactaatgccaagacatggctgtttaaaaaatttaatgttcaaacagttatcactgatgcttttgcactatttattaataaaatcatatattgtgta

SEQ ID NO: 437421 - DNA, 2039 bp, Homo sapiens
acctgggaagaggcggagaacaatatggcggatggcgaggagccaatggctgttgatggtgggtgtggggacactggagactgggaaggtcgctggaaccatgtaaagaagttcctcgagcgatctggacccttcacacaccctgatttcgaaccgagcactgaatctctccagttcttgttagatacatgtaaagttctagtcattggagctggcggcttaggatgtgagctcctgaaaaatctgactatagatgtttccaatctaaataggcagtttttatttaggcctaaagatattggaagacctaaggctgaagttgctgcagaatttctaaatgacagagttcctaattgcaatgtagttccacatttcaacaagattcaagattttaacgacactttctatcgacaatttcatattattgtatgtggactggactctatcatcgccagaagatggataaatggcatgctgatatctcttctaaattatgaagatggtgtcttagatccaagctccattgtccctttgatagatggggggacagaaggttttaaaggaaatgcccgggtgattctgcctggaatgactgcttgtatcgaatgcacgctggaactttatccaccacaggttaattttcccatgtgcaccattgcatctatgcccaggctaccagaacactgtattgagtatgtaaggatgttgcagtggcctaaggagcagccttttggagaaggggttccattagatggagatgatcctgaacatatacaatggattttccaaaaatccctagagagagcatcacaatataatattaggggtgttacgtataggctcactcaaggggtagtaaaaagaatcattcctgcagtagcttccacaaatgcagtcattgcagctgtgtgtgccactgaggtttttaaaatagccacaagtgcatacattcccttgaataattacttggtgtttaatgatgtagatgggctgtatacatacacatttgaagcagaaagaaaggaaaactgcccagcttgtagccagcttcctcaaaatattcagttttctccatcagctaaactacaggaggttttggattatctaaccaatagtgcttctctgcaaatgaaatctccagccatcacagccaccctagagggaaaaaatagaacactttacttacagtcggtaacctctattgaagaacgaacaaggccaaatctctccaaaacattgaaagaattggggcttgttgatggacaagaactggcggttgctgatgtcaccaccccacagactgtactattcaaacttcattttacttcttaaggaaaatctccacataatagaaaactcatggaaataatatactttgtggatgctaagaagttgaatcgatgtcatttttagcaatagtgttgccacgatttgtctttttttatataatgaaccactcttttttaactttgtaaccttcccttgaagacagaattttggtgttggtgcttgtaagcattttcattaataatatgagaaatgatacctggagagagagattatgagcaaatgtattgcttcttttagaggaggaagcatacaacctcttttgtgtgaattttgttattatggtcaaagaatgcattcctaagttttcatttgagtacccaaatacacaaaaggtgtccctttaaggaaaataaagaattaagttttaaataacattacattttacaatctgacatctggagtatattgaacataggctatttcttgatataacactcatttaattgtggccatccaaatgaatattattgcagaatttatcttgttcataatgatttgtaaatggtgttatagctgaatacctgtgcatgaaaatgggcaatattttcatctgtttacttgtagtgccatagaggccaatatgcacaatattaactaatgccaagacatggctgtttaaaaaatttaatgttcaaacagttatcactgatgcttttgcactatttattaataaaatcatatattgtgta

SEQ ID NO: 437422 - DNA, 1998 bp, Homo sapiens
acctgggaagaggcggagaacaatatggcggatggcgaggagccggagaagaaaagaaggagaatagaggagctgctggctgagaaaatggctgttgatggtgggtgtggggacactggagactgggaaggtcgctggaaccatgtaaagaagttcctcgagcgatctggacccttcacacaccctgatttcgaaccgagcactgaatctctccagttcttgttagatacatgtaaagttctagtcattggagctggcggcttaggatgtgagctcctgaaaaatctggccttgtctggttttagacagattcatgttatagatatggacactatagatgtttccaatctaaataggcagtttttatttagaatttcatattattgtatgtggactggactctatcatcgccagaagatggataaatggcatgctgatatctcttctaaattatgaagatggtgtcttagatccaagctccattgtccctttgatagatggggggacagaaggttttaaaggaaatgcccgggtgattctgcctggaatgactgcttgtatcgaatgcacgctggaactttatccaccacaggttaattttcccatgtgcaccattgcatctatgcccaggctaccagaacactgtattgagtatgtaaggatgttgcagtggcctaaggagcagccttttggagaaggggttccattagatggagatgatcctgaacatatacaatggattttccaaaaatccctagagagagcatcacaatataatattaggggtgttacgtataggctcactcaaggggtagtaaaaagaatcattcctgcagtagcttccacaaatgcagtcattgcagctgtgtgtgccactgaggtttttaaaatagccacaagtgcatacattcccttgaataattacttggtgtttaatgatgtagatgggctgtatacatacacatttgaagcagaaagaaaggaaaactgcccagcttgtagccagcttcctcaaaatattcagttttctccatcagctaaactacaggaggttttggattatctaaccaatagtgcttctctgcaaatgaaatctccagccatcacagccaccctagagggaaaaaatagaacactttacttacagtcggtaacctctattgaagaacgaacaaggccaaatctctccaaaacattgaaagaattggggcttgttgatggacaagaactggcggttgctgatgtcaccaccccacagactgtactattcaaacttcattttacttcttaaggaaaatctccacataatagaaaactcatggaaataatatactttgtggatgctaagaagttgaatcgatgtcatttttagcaatagtgttgccacgatttgtctttttttatataatgaaccactcttttttaactttgtaaccttcccttgaagacagaattttggtgttggtgcttgtaagcattttcattaataatatgagaaatgatacctggagagagagattatgagcaaatgtattgcttcttttagaggaggaagcatacaacctcttttgtgtgaattttgttattatggtcaaagaatgcattcctaagttttcatttgagtacccaaatacacaaaaggtgtccctttaaggaaaataaagaattaagttttaaataacattacattttacaatctgacatctggagtatattgaacataggctatttcttgatataacactcatttaattgtggccatccaaatgaatattattgcagaatttatcttgttcataatgatttgtaaatggtgttatagctgaatacctgtgcatgaaaatgggcaatattttcatctgtttacttgtagtgccatagaggccaatatgcacaatattaactaatgccaagacatggctgtttaaaaaatttaatgttcaaacagttatcactgatgcttttgcactatttattaataaaatcatatattgtgta

SEQ ID NO: 437423 - DNA, 1454 bp, Homo sapiens
acctgggaagaggcggagaacaatatggcggatggcgaggagccggagaagaaaagaaggagaatagaggagctgctggctgagaaaatggctgttgatggtgggtgtggggacactggagactgggaaggtcgctggaaccatgtaaagaagttcctcgagcgatctggacccttcacacaccctgatttcgaaccgagcactgaatctctccagttcttgttagatacatgtaaagttctagtcattggagctggcggcttaggatgtgagctcctgaaaaatctggccttgtctggttttagacagattcatgttatagatatggacactatagatgtttccaatctaaataggcagtttttatttaggcctaaagatattggaagacctaaggctgaagttgctgcagaatttctaaatgacagagttcctaattgcaatgtagttccacatttcaacaagattcaagattttaacgacactttctatcgacaatttcatattattgtatgtggactggactctatcatcgccagaagatggataaatggcatgctgatatctcttctaaattatgaagatggtgtcttagatccaagctccattgtccctttgatagatggggggacagaaggttttaaaggaaatgcccgggtgattctgcctggaatgactgcttgtatcgaatgcacgctggaactttatccaccacaggttaattttcccatgtgcaccattgcatctatgcccaggctaccagaacactgtattgagtatgtaaggatgttgcagtggcctaaggagcagccttttggagaaggggttccattagatggagatgatcctgaacatatacaatggattttccaaaaatccctagagagagcatcacaatataatattaggggtgttacgtataggctcactcaaggggtagtaaaaagaatcattcctgcagtagcttccacaaatgcagtcattgcagctgtgtgtgccactgaggtttttaaaatagccacaagtgcatacattcccttgaataattacttggtgtttaatgatgtagatgggctgtatacatacacatttgaagcagaaagaaaggaaaactgcccagcttgtagccagcttcctcaaaatattcagttttctccatcagctaaactacaggaggttttggattatctaaccaatagtgcttctctgcaaatgaaatctccagccatcacagccaccctgatgggacgaagatggatcttcgtcccatcagtcaaaaaaatttatgaaaccatgtatttcctcacctgttttaagtaaatgcttaattttttcttcatttttacaaagtaacacacttacaacatagtatcttgcatattttaaacatgacaagaagttcagctgagccccaggaagtacaggtgcccttagctgatggagcaagatgggtc

SEQ ID NO: 437424 - DNA, 3039 bp, Homo sapiens
tggttgccttagattcggttatgtaaattgtcgcaaccactaacaattgtggtctctggtgatcttatttttaaagcctgtattatttaaaatgcatttttattgaaaggcctgcattaaactgaatggtttcacaggcatttgcttgtcctgcatagtaaggaggtagaatacatagaaaattaatacaatgttttagaaacagccaagttaattttagaggcaagaacatgatttgatgctataaagtaggcattttaatattgtaaacatatactttggctgtattgaaaaatataaatccatgatggctgtacaaataatttagcctcattcattttttaaaggaattattccttaagacatgccatctctttttagatatactcaaaagactgagaggcaaaacttggcttttagctgcagcacatagccctgttatatttgatttattttacatttcatatgaaagcataattttgtccacatgtgactcaaattgcattggtaattttttttttttttgtaagttaaaaaaactacagagacactaaaggtgaaaatggatgagacaattatagtattattttcattggtctttttttttgagatggagtctcactctttcgccaggctagagtgcagtggcgccatctaggctcactgcaacctccgcatcccagattccagcgattctcctgcctcagcctcctgagtagctgggattacaggtgcctgccatcacgcctggctaatttttgtatttttagtagagacgggggttcaccaagttggccaggatggtctcgatctcttgaccttgtgactcacccgcatcggcctcccaaagtgctgggattacaggcatgagccaccgcacctgacggtcttttcaaagctatttatttttaggactatgtggtaatttcaccttcaggtgataaggattttttttttctcccagctagtgctatctttctcaaaataatttaaaagtaggcgagaggctaggatgtacctatatttaccatgtttacttaccaggaatattttctaagtgccatagtctttttcataatacgtatgagttttaccttttcagaggaataatttcaagtcatttatttgctcattaatgatagcagtagtcatagacttaagactattctagagatcttcatctccataagacttttacatttattttagtaaacttttctttctatgcctctttaatggagtggttctgttatttaagcctgttctaagtttgatcaaatggcaatgactaggtctagttttagtttttatttttgcaggagtctattgctaaagaattttattttgatccttgttaaatttttattttaattaataaggtagtcattcctgtagagggataagatgcttgtagagttgtgggtatcattccaaatagaactgttatgatttgggaaatattctttactacaaaggacttatttcataattacaaattttccttcatatttgcctttgtttataaaatcttcaggaatgacattctctagcaataaaaggaatgaaccgttatgtttctaagctgaaaagaggaacaggtgggtaattatcctgccatacttaaatatagtggaaaatcctctattgagaatgtggataaatgaacaattgtaagttttgcatcataaactgagaactttcttttgacaggggggaggcgggagggatagtaggtgggggtgatctgcttgcttcttttaccacaggtgatttttaagtaacttgggtttaatttacagagatgaaacatgacagtctgagtaaaatacccagtgatgtagaagtgtgcctgtttattatgtagatacagacatccagcaaaaacaggagaatcacatgctttaaagaacactttctcttaggtttccttgagatatgttcctccagtgcaagcaagataatggtttacagaatttgctttacacaaaacttgtcaagaactcatctgttaaaagcaaggaataactagtttatattttccaataatgttcaaggttttctccttaatatgtttgaaattattgattttggcatttttctaagcaatttatgtaattttatttgaagaaaatgttttgtataatgtttttcccagcctaaacagggagagtcctaacagtgttgtgcttgtatgattctgagactttatttgcgtaagtgatactactatactttatttttgacccatgcctttttaagctgtttcatattgaaaggtggaatattgtaaaaattttgtcaaagatgtactgtagtgctatttgaagtacctgtaacaaaacagttggccctctgtatccatgtactctgcatctgtggattaaaccaattgcagatcaaaaatattagaaaaaataaaaataatacaaataaaaatacagtataacagttatttaaatagcatttacattgcattaggtattagtctagggataaagtatacaggcggatgtgcgttggttatatacaaatatgtcattttatgtaagggacttgagtatacttggatttttggtatctgtgggttggggggacggtccaggaaccaataccccatggataccaagggacaactgtacttatttacctttattgtcattgcaagcttcttatggaaactttataggaatgaaaatatacatgttaagaagattaaacattagatagtagatggtttgttgcatgctagaactgttagtattgttgaatcaattactttggtttcatgaaaaaataaacgataaatatctttaaagagaactagaagaattttttgtttgagtgattccaggctgtagtatgatcatttactgaagtagtttgattggctggctaacttagaattattgtttcttgttttgtactgcaataggggttataattgtaagataaaaatgtgtgtgtgtttaagggaagtaggtggtggttaaaattcttggaaaattttcagaatactttaaaaataaagttccaagttac

SEQ ID NO: 437425 - DNA, 2824 bp, Homo sapiens
tggttgccttagattcggttatgtaaattgtcgcaaccactaacaattgtggtctctggtgatcttatttttaaagcctgtattatttaaaatgcatttttattgaaaggcctgcattaaactgaatggtttcacaggcatttgcttgtcctgcatagtaaggaggtagaatacatagaaaattaatacaatgttttagaaacagccaagttaattttagaggcaagaacatgatttgatgctataaagtaggcattttaatattgtaaacatatactttggctgtattgaaaaatataaatccatgatggctgtacaaataatttagcctcattcattttttaaaggaattattccttaagacatgccatctctttttagatatactcaaaagactgagaggcaaaacttggcttttagctgcagcacatagccctgttatatttgatttattttacatttcatatgaaagcataattttgtccacatgtgactcaaattgcattggtaattttttttttttttgtaagttaaaaaaactacagagacactaaaggtgaaaatggatgagacaattatagtattattttcattggtctttttttttgagatggagtctcactctttcgccaggctagagtgcagtggcgccatctaggctcactgcaacctccgcatcccagattccagcgattctcctgcctcagcctcctgagtagctgggattacaggtgcctgccatcacgcctggctaatttttgtatttttagtagagacgggggttcaccaagttggccaggatggtctcgatctcttgaccttgtgactcacccgcatcggcctcccaaagtgctgggattacaggcatgagccaccgcacctgacggtcttttcaaagctatttatttttaggactatgtggtaatttcaccttcaggtgataaggattttttttttctcccagctagtgctatctttctcaaaataatttaaaagtaggcgagaggctaggatgtacctatatttaccatgtttacttaccaggaatattttctaagtgccatagtctttttcataatacgtatgagttttaccttttcagaggaataatttcaagtcatttatttgctcattaatgatagcagtagtcatagacttaagactattctagagatcttcatctccataagacttttacatttattttagtaaacttttctttctatgcctctttaatggagtggttctgttatttaagcctgttctaagtttgatcaaatggcaatgactaggtctagttttagtttttatttttgcaggagtctattgctaaagaattttattttgatccttgttaaatttttattttaattaataaggtagtcattcctgtagagggataagatgcttgtagagttgtgggtatcattccaaatagaactgttatgatttgggaaatattctttactacaaaggacttatttcataattacaaattttccttcatatttgcctttgtttataaaatcttcaggaatgacattctctagcaataaaaggaatgaaccgttatgtttctaagctgaaaagaggaacaggtgggtaattatcctgccatacttaaatatagtggaaaatcctctattgagaatgtggataaatgaacaattgtaagttttgcatcataaactgagaactttcttttgacaggggggaggcgggagggatagtaggtgggggtgatctgcttgcttcttttaccacaggtgatttttaagtaacttgggtttaatttacagagatgaaacatgacagtctgagtaaaatacccagtgatgtagaagtgtgcctgtttattatgtagatacagacatccagcaaaaacaggagaatcacatgctttaaagaacactttctcttaggtttccttgagatatgttcctccagtgcaagcaagataatggtttacagaatttgctttacacaaaacttgtcaagaactcatctgttaaaagcaaggaataactagtttatattttccaataatgttcaaggttttctccttaatatgtttgaaattattgattttggcatttttctaagcaatttatgtaattttatttgaagaaaatgttttgtataatgtttttcccagcctaaacagggagagtcctaacagtgttgtgcttgtatgattctgagactttatttgcgtaagtgatactactatactttatttttgacccatgcctttttaagctgtttcatattgaaaggtggaatattgtaaaaattttgtcaaagatgtactgtagtgctatttgaagtacctgtaacaaaacagttggccctctgtatccatgtactctgcatctgtggattaaaccaattgcagatcaaaaatattagaaaaaataaaaataatacaaataaaaatacagtataacagttatttaaatagcatttacattgcattaggtattagtctagggataaagtatacaggcggatgtgcgttggttatatacaaatatgtcattttatgtaagggacttgagtatacttggatttttggtatctgtgggttggggggacggtccaggaaccaataccccatggataccaagggacaactgtacttatttacctttattgtcattgcaagcttcttatggaaactttataggaatgaaaatatacatgttaagaagattaaacattagatagtagatggtttgttgcatgctagaactgttagtattgttgaatcaattactttggtttcatgaaaaaataaacgataaatatctttaaagagaactag

SEQ ID NO: 437426 - DNA, 298 bp, Homo sapiens
  misc_feature (18)..(18): n is a, c, g, or t
  misc_feature (20)..(20): n is a, c, g, or t
  misc_feature (23)..(23): n is a, c, g, or t
acatgatagaatcgagcncngtncccctagtttagaagtttaaatagcatttacattgcattaggtattagtctagggataaagtatacaggcggatgtgcgttggttatatacaaatatgtcattttatgtaagggacttgagtatacttggatttttggtatctgtgggttggggggacggtccaggaaccaataccccatggataccaagggacaactgtacttatttacctttattgtcattgctgcctggggaacttctaaaactaggtgctattgaaacttctaaaactagg

SEQ ID NO: 437427 - DNA, 2964 bp, Homo sapiens
tggttgccttagattcggttatgtaaattgtcgcaaccactaacaattgtggtctctggtgatcttatttttaaagcctgtattatttaaaatgcatttttattgaaaggcctgcattaaactgaatggtttcacaggcatttgcttgtcctgcatagtaaggaggtagaatacatagaaaattaatacaatgttttagaaacagccaagttaattttagaggcaagaacatgatttgatgctataaagtaggcattttaatattgtaaacatatactttggctgtattgaaaaatataaatccatgatggctgtacaaataatttagcctcattcattttttaaaggaattattccttaagacatgccatctctttttagatatactcaaaagactgagaggcaaaacttggcttttagctgcagcacatagccctgttatatttgatttattttacatttcatatgaaagcataattttgtccacatgtgactcaaattgcattggtaattttttttttttttgtaagttaaaaaaactacagagacactaaaggtgaaaatggatgagacaattatagtattattttcattggtctttttttttgagatggagtctcactctttcgccaggctagagtgcagtggcgccatctaggctcactgcaacctccgcatcccagattccagcgattctcctgcctcagcctcctgagtagctgggattacaggtgcctgccatcacgcctggctaatttttgtatttttagtagagacgggggttcaccaagttggccaggatggtctcgatctcttgaccttgtgactcacccgcatcggcctcccaaagtgctgggattacaggcatgagccaccgcacctgacggtcttttcaaagctatttatttttaggactatgtggtaatttcaccttcaggtgataaggattttttttttctcccagctagtgctatctttctcaaaataatttaaaagtaggcgagaggctaggatgtacctatatttaccatgtttacttaccaggaatattttctaagtgccatagtctttttcataatacgtatgagttttaccttttcagaggaataatttcaagtcatttatttgctcattaatgatagcagtagtcatagacttaagactattctagagatcttcatctccataagacttttacatttattttagtaaacttttctttctatgcctctttaatggagtggttctgttatttaagcctgttctaagtttgatcaaatggcaatgactaggtctagttttagtttttatttttgcaggagtctattgctaaagaattttattttgatccttgttaaatttttattttaattaataaggtagtcattcctgtagagggataagatgcttgtagagttgtgggtatcattccaaatagaactgttatgatttgggaaatattctttactacaaaggacttatttcataattacaaattttccttcatatttgcctttgtttataaaatcttcaggaatgacattctctagcaataaaaggaatgaaccgttatgtttctaagctgaaaagaggaacaggtgggtaattatcctgccatacttaaatatagtggaaaatcctctattgagaatgtggataaatgaacaattgtaagttttgcatcataaactgagaactttcttttgacaggggggaggcgggagggatagtaggtgggggtgatctgcttgcttcttttaccacaggtgatttttaagtaacttgggtttaatttacagagatgaaacatgacagtctgagtaaaatacccagtgatgtagaagtgtgcctgtttattatgtagatacagacatccagcaaaaacaggagaatcacatgctttaaagaacactttctcttaggtttccttgagatatgttcctccagtgcaagcaagataatggtttacagaatttgctttacacaaaacttgtcaagaactcatctgttaaaagcaaggaataactagtttatattttccaataatgttcaaggttttctccttaatatgtttgaaattattgattttggcatttttctaagcaatttatgtaattttatttgaagaaaatgttttgtataatgtttttcccagcctaaacagggagagtcctaacagtgttgtgcttgtatgattctgagactttatttgcgtaagtgatactactatactttatttttgacccatgcctttttaagctgtttcatattgaaaggtggaatattgtaaaaattttgtcaaagatgtactgtagtgctatttgaagtacctgtaacaaaacagttggccctctgtatccatgtactctgcatctgtggattaaaccaattgcagatcaaaaatattagaaaaaataaaaataatacaaataaaaatacagtataacagttatttaaatagcatttacattgcattaggtattagtctagggataaagtatacaggcggatgtgcgttggttatatacaaatatgtcattttatgtaagggacttgagtatacttggatttttggtatctgtgggttggggggacggtccaggaaccaataccccatggataccaagggacaactgtacttatttacctttattgtcattgcaagcttcttatggaaactttataggaatgaaaatatacatgttaagaagattaaacattagatagtagatggtttgttgcatgctagaactgttagtattgttgaatcaattactttggtttcatgaaaaaataaacgataaatatctttaaagagaactagaagaattttttgtttgagtgattccaggctgtagtatgatcatttactgaagtagtttgattggctggctaacttagaattattgtttcttgttttgtactgcaataaagaaggaaataacgggatcctctagaacagct

SEQ ID NO: 437428 - DNA, 2712 bp, Homo sapiens
tggttgccttagattcggttatgtaaattgtcgcaaccactaacaattgtggtctctggtgatcttatttttaaagcctgtattatttaaaatgcatttttattgaaaggcctgcattaaactgaatggtttcacaggcatttgcttgtcctgcatagtaaggaggtagaatacatagaaaattaatacaatgttttagaaacagccaagttaattttagaggcaagaacatgatttgatgctataaagtaggcattttaatattgtaaacatatactttggctgtattgaaaaatataaatccatgatggctgtacaaataatttagcctcattcattttttaaaggaattattccttaagacatgccatctctttttagatatactcaaaagactgagaggcaaaacttggcttttagctgcagcacatagccctgttatatttgatttattttacatttcatatgaaagcataattttgtccacatgtgactcaaattgcattggtaattttttttttttttgtaagttaaaaaaactacagagacactaaaggtgaaaatggatgagacaattatagtattattttcattggtctttttttttgagatggagtctcactctttcgccaggctagagtgcagtggcgccatctaggctcactgcaacctccgcatcccagattccagcgattctcctgcctcagcctcctgagtagctgggattacaggtgcctgccatcacgcctggctaatttttgtatttttagtagagacgggggttcaccaagttggccaggatggtctcgatctcttgaccttgtgactcacccgcatcggcctcccaaagtgctgggattacaggcatgagccaccgcacctgacggtcttttcaaagctatttatttttaggactatgtggtaatttcaccttcaggtgataaggattttttttttctcccagctagtgctatctttctcaaaataatttaaaagtaggcgagaggctaggatgtacctatatttaccatgtttacttaccaggaatattttctaagtgccatagtctttttcataatacgtatgagttttaccttttcagaggaataatttcaagtcatttatttgctcattaatgatagcagtagtcatagacttaagactattctagagatcttcatctccataagacttttacatttattttagtaaacttttctttctatgcctctttaatggagtggttctgttatttaagcctgttctaagtttgatcaaatggcaatgactaggtctagttttagtttttatttttgcaggagtctattgctaaagaattttattttgatccttgttaaatttttattttaattaataaggtagtcattcctgtagagggataagatgcttgtagagttgtgggtatcattccaaatagaactgttatgatttgggaaatattctttactacaaaggacttatttcataattacaaattttccttcatatttgcctttgtttataaaatcttcaggaatgacattctctagcaataaaaggaatgaaccgttatgtttctaagctgaaaagaggaacaggtgggtaattatcctgccatacttaaatatagtggaaaatcctctattgagaatgtggataaatgaacaattgtaagttttgcatcataaactgagaactttcttttgacaggggggaggcgggagggatagtaggtgggggtgatctgcttgcttcttttaccacaggtgatttttaagtaacttgggtttaatttacagagatgaaacatgacagtctgagtaaaatacccagtgatgtagaagtgtgcctgtttattatgtagatacagacatccagcaaaaacaggagaatcacatgctttaaagaacactttctcttaggtttccttgagatatgttcctccagtgcaagcaagataatggtttacagaatttgctttacacaaaacttgtcaagaactcatctgttaaaagcaaggaataactagtttatattttccaataatgttcaaggttttctccttaatatgtttgaaattattgattttggcatttttctaagcaatttatgtaattttatttgaagaaaatgttttgtataatgtttttcccagcctaaacagggagagtcctaacagtgttgtgcttgtatgattctgagactttatttgcgtaagtgatactactatactttatttttgacccatgcctttttaagctgtttcatattgaaaggtggaatattgtaaaaattttgtcaaagatgtactgtagtgctatttgaagtacctgtaacaaaacagttggccctctgtatccatgtactctgcatctgtggattaaaccaattgcagatcaaaaatattagaaaaaataaaaataatacaaataaaaatacagtataacagttatttaaatagcatttacattgcattaggtattagtctagggataaagtatacaggcggatgtgcgttggttatatacaaatatgtcattttatgtaagggacttgagtatacttggatttttggtatctgtgggttggggggacggtccaggaaccaataccccatggataccaagggacaactgtacttatttacctttattgtcattgctgcctggggaacttctaaaactaggtgctattgaaacttctaaaactagg

SEQ ID NO: 437429 - DNA, 2769 bp, Homo sapiens
tggttgccttagattcggttatgtaaattgtcgcaaccactaacaattgtggtctctggtgatcttatttttaaagcctgtattatttaaaatgcatttttattgaaaggcctgcattaaactgaatggtttcacaggcatttgcttgtcctgcatagtaaggaggtagaatacatagaaaattaatacaatgttttagaaacagccaagttaattttagaggcaagaacatgatttgatgctataaagtaggcattttaatattgtaaacatatactttggctgtattgaaaaatataaatccatgatggctgtacaaataatttagcctcattcattttttaaaggaattattccttaagacatgccatctctttttagatatactcaaaagactgagaggcaaaacttggcttttagctgcagcacatagccctgttatatttgatttattttacatttcatatgaaagcataattttgtccacatgtgactcaaattgcattggtaattttttttttttttgtaagttaaaaaaactacagagacactaaaggtgaaaatggatgagacaattatagtattattttcattggtctttttttttgagatggagtctcactctttcgccaggctagagtgcagtggcgccatctaggctcactgcaacctccgcatcccagattccagcgattctcctgcctcagcctcctgagtagctgggattacaggtgcctgccatcacgcctggctaatttttgtatttttagtagagacgggggttcaccaagttggccaggatggtctcgatctcttgaccttgtgactcacccgcatcggcctcccaaagtgctgggattacaggcatgagccaccgcacctgacggtcttttcaaagctatttatttttaggactatgtggtaatttcaccttcaggtgataaggattttttttttctcccagctagtgctatctttctcaaaataatttaaaagtaggcgagaggctaggatgtacctatatttaccatgtttacttaccaggaatattttctaagtgccatagtctttttcataatacgtatgagttttaccttttcagaggaataatttcaagtcatttatttgctcattaatgatagcagtagtcatagacttaagactattctagagatcttcatctccataagacttttacatttattttagtaaacttttctttctatgcctctttaatggagtggttctgttatttaagcctgttctaagtttgatcaaatggcaatgactaggtctagttttagtttttatttttgcaggagtctattgctaaagaattttattttgatccttgttaaatttttattttaattaataaggtagtcattcctgtagagggataagatgcttgtagagttgtgggtatcattccaaatagaactgttatgatttgggaaatattctttactacaaaggacttatttcataattacaaattttccttcatatttgcctttgtttataaaatcttcaggaatgacattctctagcaataaaaggaatgaaccgttatgtttctaagctgaaaagaggaacaggtgggtaattatcctgccatacttaaatatagtggaaaatcctctattgagaatgtggataaatgaacaattgtaagttttgcatcataaactgagaactttcttttgacaggggggaggcgggagggatagtaggtgggggtgatctgcttgcttcttttaccacaggtgatttttaagtaacttgggtttaatttacagagatgaaacatgacagtctgagtaaaatacccagtgatgtagaagtgtgcctgtttattatgtagatacagacatccagcaaaaacaggagaatcacatgctttaaagaacactttctcttaggtttccttgagatatgttcctccagtgcaagcaagataatggtttacagaatttgctttacacaaaacttgtcaagaactcatctgttaaaagcaaggaataactagtttatattttccaataatgttcaaggttttctccttaatatgtttgaaattattgattttggcatttttctaagcaatttatgtaattttatttgaagaaaatgttttgtataatgtttttcccagcctaaacagggagagtcctaacagtgttgtgcttgtatgattctgagactttatttgcgtaagtgatactactatactttatttttgacccatgcctttttaagctgtttcatattgaaaggtggaatattgtaaaaattttgtcaaagatgtacttctgcatctgtggattaaaccaattgcagatcaaaaatattagaaaaaataaaaataatacaaataaaaatacagtataacagttatttaaatagcatttacattgcattaggtattagtctagggataaagtatacaggcggatgtgcgttggttatatacaaatatgtcattttatgtaagggacttgagtatacttggatttttggtatctgtgggttggggggacggtccaggaaccaataccccatggataccaagggacaactgtacttatttacctttattgtcattgcaagcttcttatggaaactttataggaatgaaaatatacatgttaagaagattaaacattagatagtagatggtttgttgcatgctagaactgttagtattgttgaatcaattactttggtttcatgaaaaaataaacgataaatatctttaaagagaactag

SEQ ID NO: 437430 - DNA, 667 bp, Homo sapiens
cctaatgtacttttggaatcagagcaaagcaatcctttttgcagttattcagagcatcaggagaaaaatgatgtcttcctgtaccgatgcagtgtttgtgctaaaagtttccgatctccatctaaactggaaagacactacctaattcatgcagggcagaaaccatttgaatgctcagtttgtggcaaaacattcagacaggctcctcactggaagagacatcaacttactcactttaaagaacgaccacaagggaaagtggttgccttagattcggttatgtaaattgtcgcaaccactaacaattgtggtctctggtgatcttatttttaaagcctgtattatttaaaatgcatttttattgaaaggcctgcattaaactgaatggtttcacaggcatttgcttgtcctgcatagtaaggaggtagaatacatagaaaattaatacaatgttttagaaacagccaagttaattttagaggcaagaacatgatttgatgctataaagtaggcattttaatattgtaaacatatactttggctgtattgaaaaatataaatccatgatggctgtacaaataatttagcctcattcattttttaaaggaattattccttaagacatgccatctctttttagatatactcaaaagactgagaggcaaaa

SEQ ID NO: 437431 - DNA, 896 bp, Homo sapiens
ctgacaaatggtcccatgggtccgggggcacgcttttcacaacgtggagatgcagggtcatgggctgcctgctaccacgaggcggaaggggatggtgctgggcaccagcctgccccggggctgggtttctcctgggcctgggccgaggggtggaggcctgtgggtgacgtgttcaagacggctcagcaaccccacctgacagtgtccaggtggggcctctcccccacccccaggctccccagggagcacagcctccactcctacacactggctactctgccggagggggaggccgtgctggagtgatgcctggcgcgtgttgtgtgatgggagaattgggtatttacagtttaataacgagatctcgatgccgtcgatcggccctgctccaggcccttggcttatctggcttttgaacgtggtttatagagtggtgacggtgccgcttattaaatgcttagctgggcctggcgtgggtgtggcggccgccagggccccggtgctggctcgggcaggtgttgcagcgggagcctcaagggatgaaaggtggctctccggtgctccctcctcaccaaggaggcttctctcagggcttcttattaaaagccgatgtaaaggacctgcgcgatggctcacgcctgtaatcccagcactttaggaggtcaaggcgggaggatcccttgagctcaggagtttgagagcagcctggacaatatagcaagactccacctctacaaaagtcaaaaattagccaggcatgatggttgcacctgtggtcccagctactcaggaggctgaggtgggaggattgcttgagcccaggagttggagaccgcagtgagctatgatcgcgccgtgtgctccagcctgggtgacagagcacccaggctcaaaaa

SEQ ID NO: 437432 - DNA, 218 bp, Homo sapiens
gcggccgcctactactactactgctcgaattcaagcttctaacgatgtacggggacatgtaacagccaggagtgttaagcgttcagtgatgtggggtgaaaagttactacctgtcaaggtttgtgttaccctcctgtaaatggtgtacataatgtattgttggtaattattttggtacttttatgatgtatatttattaaacagatttttacaaatga

SEQ ID NO: 437433 - DNA, 803 bp, Homo sapiens
tctacataatgagtctctcaaatttctgtgcataaccagtatcccaagaatgtacctgcccccctttaatagcttactctttttttaaagagaagcattaaaggcaaactccctcagcctgtaaagttcattatatttgggctatggagaatggagtccaagagttatttccagtagtggcctccccatcccggtagcttggcagagctccgctccggaagcttaacgtgtcttttttccccttgttttcagctgccctatgatgactgtgtgtttggaggccagcgtctgacgttatgagcgcaaaggggctgaaagaacatggacttgtatatttgtacaaaaaaaaagttttatttttctaaaaaaagaaaaaagaagaaaaaatttaaagggtgtacttatatccacactgcacactgcctggcccaaaacgtcttattgtggtaggatcagccctcattttgttgcttttgtgaactttttgtaggggacgagaaagatcattgaaattctgagaaaacttcttttaaacctcacctttgtggggtttttggagaaggttatcaaaaatttcatggaaggaccacattttatatttattgtgcttcgagtgactgaccccagtggtatcctgtgacatgtaacagccaggagtgttaagcgttcagtgatgtggggtgaaaagttactacctgtcaaggtttgtgttaccctcctgtaaatggtgtacataatgtattgttggtaattattttggtacttttatgatgtatatttattaaacagatttttacaaatga

SEQ ID NO: 437434 - DNA, 1166 bp, Homo sapiens
aaaagatcaaaaaacggaaaggaccggcaggttggcaaaccccaaagagggaccgcccatcaggtcggcgtccttgggatctcagcagccgacgaccccaattcaaatcgatcgtgggaaaccccagggaaagaaggctcacttgcagagggacaggattacagggtgcaggctgcagggaagtaccggggggagggggcctggtcggaaggactttccagccactcggcgctcatcaaaaagttccctgtccgtgaccctagtggctcatcgcagggagtttctccgatgaaccccagctcagggtttaggcttctttttccccctagcagaggacgaagccagttctctttttctggtctgactggcttggaaattccccgagcctgaccccgccccagagaaatccccagccagcgtttatagggcgccgcggcggcgctgcagagcccacagcagtccgtgccgccgtcccgcccgccagcgccccagcgaggaagcagcgcgcagcccgcggcccagcgcacccgcagcagcgcccgcagctcgtccgcgccatgttccaggcggccgagcgcccccaggagtgggccatggagggcccccgcgacgggctgaagaaggagcggctactggacgaccgccacgacagcggcctggactccatgaaagacgaggagtacgagcagatggtcaaggagctgcaggagatccgcctcgagccgcaggaggtgccgcgcggctcggagccctggaagcagcagctcaccgaggacggggactcgttcctgcacttggccatcatccatgaagaaaaggcactgaccatggaagtgatccgccaggtgaagggagacctggccttcctcaacttccagaacaacctgcagcagactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtccttgacaccggactcatcctcctgaaggtacaatacatggccccgttttacctttagctcttcatggtactggatcgggagcttgggctgggtgcgtgcatgtcggaccgta

SEQ ID NO: 437435 - DNA, 2649 bp, Homo sapiens
  misc_feature (2028)..(2028): n is a, c, g, or t
  misc_feature (2031)..(2031): n is a, c, g, or t
  misc_feature (2035)..(2035): n is a, c, g, or t
aaaagatcaaaaaacggaaaggaccggcaggttggcaaaccccaaagagggaccgcccatcaggtcggcgtccttgggatctcagcagccgacgaccccaattcaaatcgatcgtgggaaaccccagggaaagaaggctcacttgcagagggacaggattacagggtgcaggctgcagggaagtaccggggggagggggcctggtcggaaggactttccagccactcggcgctcatcaaaaagttccctgtccgtgaccctagtggctcatcgcagggagtttctccgatgaaccccagctcagggtttaggcttctttttccccctagcagaggacgaagccagttctctttttctggtctgactggcttggaaattccccgagcctgaccccgccccagagaaatccccagccagcgtttatagggcgccgcggcggcgctgcagagcccacagcagtccgtgccgccgtcccgcccgccagcgccccagcgaggaagcagcgcgcagcccgcggcccagcgcacccgcagcagcgcccgcagctcgtccgcgccatgttccaggcggccgagcgcccccaggagtgggccatggagggcccccgcgacgggctgaagaaggagcggctactggacgaccgccacgacagcggcctggactccatgaaagacgaggagtacgagcagatggtcaaggagctgcaggagatccgcctcgagccgcaggaggtgccgcgcggctcggagccctggaagcagcagctcaccgaggacggggactcgttcctgcacttggccatcatccatgaagaaaaggcactgaccatggaagtgatccgccaggtgaagggagacctggccttcctcaacttccagaacaacctgcagcagactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtcctgcaccaccccgcacctccactccatcctgaaggctaccaactacaatggccacacgtgtctacacttagcctctatccatggctacctgggcatcgtggagcttttggtgtccttgggtgctgatgtcaatgctcaggagccctgtaatggccggactgcccttcacctcgcagtggacctgcaaaatcctgacctggtgtcactcctgttgaagtgtggggctgatgtcaacagagttacctaccagggctattctccctaccagctcacctggggccgcccaagcacccggatacagcagcagctgggccagctgacactagaaaaccttcagatgctgccagagagtgaggatgaggagagctatgacacagagtcagagttcacggagttcacagaggacgagctgccctatgatgactgtgtgtttggaggccagcgtctgacgttatgagcgcaaaggggctgaaagaacatggacttgtatatttgtacaaaaaaaaagttttatttttctaaaaaaagaaaaaagaagaaaaaatttaaagggtgtacttatatccacactgcacactgcctggcccaaaacgtcttattgtggtaggatcagccctcattttgttgcttttgtgaactttttgtaggggacgagaaagatcattgaaattctgagaaaacttcttttaaacctcacctttgtggggtttttggagaaggttatcaaaaatttcatggaaggaccacattttatatttattgtgcttcgagtgactgaccccagtggtatcctgtgacatgtaacagccaggagtgttaagcgttcagtgatgtggggtgaaaagttactacctgtcaaggtttgtgttaccctcctgtaaatggtgtacataatgtattgttggtaattattttggtacttttatgatgtatatttattaaacagatttttacaaatgaaaaaaaaaaaaaanaanaaanaaaaaaatgtgtgtgtggggcggccggggcccgtggagaaaagtttctaaaacacattgtggttgtggggggcggggcccagacaggggataggatacaccggggccaaaggcgtggccccaagaagagaaccggggtccgagaacacggctgtggggcatccccaccacaaaaaaaaaacgcccgggacgggacacgagacgggtttcggaaacaaatcacaagggacccacgggggccacacgggggctcttatacacgggaggccaagggcagcacgggactactaaaaatacgccccgggggggggagtaaaaaatagaagagaggaaacgcaaaggacgagaacacacggaggacgcgagagcgtaacagccaagagagggcagaacagaaggaacgggcaaaacggagagggagcggagggaaggggagaggcgacgggcggaagacgagggcaaggcgggggcggaggaagagcgcaaagacgaagaggaaagacaagagacgagagggggaagacgggggagacggacagccgcaaagagaagagaagagagaaggaggggaaaacggaaggggagcggaaggacgaggcacagaaagagagaaac

SEQ ID NO: 437436 - DNA, 2138 bp, Homo sapiens
  misc_feature (2028)..(2028): n is a, c, g, or t
  misc_feature (2031)..(2031): n is a, c, g, or t
  misc_feature (2035)..(2035): n is a, c, g, or t
  misc_feature (2095)..(2095): n is a, c, g, or t
aaaagatcaaaaaacggaaaggaccggcaggttggcaaaccccaaagagggaccgcccatcaggtcggcgtccttgggatctcagcagccgacgaccccaattcaaatcgatcgtgggaaaccccagggaaagaaggctcacttgcagagggacaggattacagggtgcaggctgcagggaagtaccggggggagggggcctggtcggaaggactttccagccactcggcgctcatcaaaaagttccctgtccgtgaccctagtggctcatcgcagggagtttctccgatgaaccccagctcagggtttaggcttctttttccccctagcagaggacgaagccagttctctttttctggtctgactggcttggaaattccccgagcctgaccccgccccagagaaatccccagccagcgtttatagggcgccgcggcggcgctgcagagcccacagcagtccgtgccgccgtcccgcccgccagcgccccagcgaggaagcagcgcgcagcccgcggcccagcgcacccgcagcagcgcccgcagctcgtccgcgccatgttccaggcggccgagcgcccccaggagtgggccatggagggcccccgcgacgggctgaagaaggagcggctactggacgaccgccacgacagcggcctggactccatgaaagacgaggagtacgagcagatggtcaaggagctgcaggagatccgcctcgagccgcaggaggtgccgcgcggctcggagccctggaagcagcagctcaccgaggacggggactcgttcctgcacttggccatcatccatgaagaaaaggcactgaccatggaagtgatccgccaggtgaagggagacctggccttcctcaacttccagaacaacctgcagcagactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtcctgcaccaccccgcacctccactccatcctgaaggctaccaactacaatggccacacgtgtctacacttagcctctatccatggctacctgggcatcgtggagcttttggtgtccttgggtgctgatgtcaatgctcaggagccctgtaatggccggactgcccttcacctcgcagtggacctgcaaaatcctgacctggtgtcactcctgttgaagtgtggggctgatgtcaacagagttacctaccagggctattctccctaccagctcacctggggccgcccaagcacccggatacagcagcagctgggccagctgacactagaaaaccttcagatgctgccagagagtgaggatgaggagagctatgacacagagtcagagttcacggagttcacagaggacgagctgccctatgatgactgtgtgtttggaggccagcgtctgacgttatgagcgcaaaggggctgaaagaacatggacttgtatatttgtacaaaaaaaaagttttatttttctaaaaaaagaaaaaagaagaaaaaatttaaagggtgtacttatatccacactgcacactgcctggcccaaaacgtcttattgtggtaggatcagccctcattttgttgcttttgtgaactttttgtaggggacgagaaagatcattgaaattctgagaaaacttcttttaaacctcacctttgtggggtttttggagaaggttatcaaaaatttcatggaaggaccacattttatatttattgtgcttcgagtgactgaccccagtggtatcctgtgacatgtaacagccaggagtgttaagcgttcagtgatgtggggtgaaaagttactacctgtcaaggtttgtgttaccctcctgtaaatggtgtacataatgtattgttggtaattattttggtacttttatgatgtatatttattaaacagatttttacaaatgaaaaaaaaaaaaaanaanaaanaaaaaaaaaaaaaaaaaaaaaaaaaaaaaaaaaaaaaaaaaaaaaaaaaaaaaaaaaaanaggaggggggcgcgcgcccgagacccccccgggggggcgccca

SEQ ID NO: 437437 - DNA, 2053 bp, Homo sapiens
aaaagatcaaaaaacggaaaggaccggcaggttggcaaaccccaaagagggaccgcccatcaggtcggcgtccttgggatctcagcagccgacgaccccaattcaaatcgatcgtgggaaaccccagggaaagaaggctcacttgcagagggacaggattacagggtgcaggctgcagggaagtaccggggggagggggcctggtcggaaggactttccagccactcggcgctcatcaaaaagttccctgtccgtgaccctagtggctcatcgcagggagtttctccgatgaaccccagctcagggtttaggcttctttttccccctagcagaggacgaagccagttctctttttctggtctgactggcttggaaattccccgagcctgaccccgccccagagaaatccccagccagcgtttatagggcgccgcggcggcgctgcagagcccacagcagtccgtgccgccgtcccgcccgccagcgccccagcgaggaagcagcgcgcagcccgcggcccagcgcacccgcagcagcgcccgcagctcgtccgcgccatgttccaggcggccgagcgcccccaggagtgggccatggagggcccccgcgacgggctgaagaaggagcggctactggacgaccgccacgacagcggcctggactccatgaaagacgaggagtacgagcagatggtcaaggagctgcaggagatccgcctcgagccgcaggaggtgccgcgcggctcggagccctggaagcagcagctcaccgaggacggggactcgttcctgcacttggccatcatccatgaagaaaaggcactgaccatggaagtgatccgccaggtgaagggagacctggccttcctcaacttccagaacaacctgcagcagactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtcctgcaccaccccgcacctccactccatcctgaaggctaccaactacaatggccacacgtgtctacacttagcctctatccatggctacctgggcatcgtggagcttttggtgtccttgggtgctgatgtcaatgctcaggagccctgtaatggccggactgcccttcacctcgcagtggacctgcaaaatcctgacctggtgtcactcctgttgaagtgtggggctgatgtcaacagagttacctaccagggctattctccctaccagctcacctggggccgcccaagcacccggatacagcagcagctgggccagctgacactagaaaaccttcagatgctgccagagagtgaggatgaggagagctatgacacagagtcagagttcacggagttcacagaggacgagctgccctatgatgactgtgtgtttggaggccagcgtctgacgttatgagcgcaaaggggctgaaagaacatggacttgtatatttgtacaaaaaaaaagttttatttttctaaaaaaagaaaaaagaagaaaaaatttaaagggtgtacttatatccacactgcacactgcctggcccaaaacgtcttattgtggtaggatcagccctcattttgttgcttttgtgaactttttgtaggggacgagaaagatcattgaaattctgagaaaacttcttttaaacctcacctttgtggggtttttggagaaggttatcaaaaatttcatggaaggaccacattttatatttattgtgcttcgagtgactgaccccagtggtatcctgtgacatgtaacagccaggagtgttaagcgttcagtgatgtggggtgaaaagttactacctgtcaaggtttgtgttaccctcctgtaaatggtgtacataatgtattgttggtaattattttggtacttttatgatgtatatttattaaacagatttttacaaatgagtcgacgcggccgcgaatttagtagtagtaatagtagta

SEQ ID NO: 437438 - DNA, 1992 bp, Homo sapiens
aaaagatcaaaaaacggaaaggaccggcaggttggcaaaccccaaagagggaccgcccatcaggtcggcgtccttgggatctcagcagccgacgaccccaattcaaatcgatcgtgggaaaccccagggaaagaaggctcacttgcagagggacaggattacagggtgcaggctgcagggaagtaccggggggagggggcctggtcggaaggactttccagccactcggcgctcatcaaaaagttccctgtccgtgaccctagtggctcatcgcagggagtttctccgatgaaccccagctcagggtttaggcttctttttccccctagcagaggacgaagccagttctctttttctggtctgactggcttggaaattccccgagcctgaccccgccccagagaaatccccagccagcgtttatagggcgccgcggcggcgctgcagagcccacagcagtccgtgccgccgtcccgcccgccagcgccccagcgaggaagcagcgcgcagcccgcggcccagcgcacccgcagcagcgcccgcagctcgtccgcgccatgttccaggcggccgagcgcccccaggagtgggccatggagggcccccgcgacgggctgaagaaggagcggctactggacgaccgccacgacagcggcctggactccatgaaagacgaggagtacgagcagatggtcaaggagctgcaggagatccgcctcgagccgcaggaggtgccgcgcggctcggagccctggaagcagcagctcaccgaggacggggactcgttcctgcacttggccatcatccatgaagaaaaggcactgaccatggaagtgatccgccaggtgaagggagacctggccttcctcaacttccagaacaacctgcagcagactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtcctgcaccaccccgcacctccactccatcctgaaggctaccaactacaatggccacacgtgtctacacttagcctctatccatggctacctgggcatcgtggagcttttggtgtccttgggtgctgatgtcaatgctcaggagccctgtaatggccggactgcccttcacctcgcagtggacctgcaaaatcctgacctggtgtcactcctgttgaagtgtggggctgatgtcaacagagttacctaccagggctattctccctaccagctcacctggggccgcccaagcacccggatacagcagcagctgggccagctgacactagaaaaccttcagatgctgccagagagtgaggatgaggagagctatgacacagagtcagagttcacggagttcacagaggacgagctgccctatgatgactgtgtgtttggaggccagcgtctgacgttatgagcgcaaaggggctgaaagaacatggacttgtatatttgtacaaaaaaaaagttttatttttctaaaaaaagaaaaaagaagaaaaaatttaaagggtgtacttatatccacactgcacactgcctggcccaaaacgtcttattgtggtaggatcagccctcattttgttgcttttgtgaactttttgtaggggacgagaaagatcattgaaattctgagaaaacttcttttaaacctcacctttgtggggtttttggagaaggttatcaaaaatttcatggaaggaccacattttatatttattgtgcttcgagtgactgaccccagtggtatcctgtgacatgtaacagccaggagtgttaagcgttcagtgatgtggggtgtgtattgttggcaataatttggtccttctatgacgcctatttatcaaaccactttttcccatcccatctgccaaccgcccgtcgcccccctttggccc

SEQ ID NO: 437439 - DNA, 1245 bp, Homo sapiens
tgccagccctccccacccccctgtctaggaggagcagcacccaacaggagacacgggttgaggggaactcggggtgtgggtttggtccatggcttactttctctggtctctcttgcattcgtagactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtcctgcaccaccccgcacctccactccatcctgaaggctaccaactacaatggccacacgtgtctacacttagcctctatccatggctacctgggcatcgtggagcttttggtgtccttgggtgctgatgtcaatgctcaggagccctgtaatggccggactgcccttcacctcgcagtggacctgcaaaatcctgacctggtgtcactcctgttgaagtgtggggctgatgtcaacagagttacctaccagggctattctccctaccagctcacctggggccgcccaagcacccggatacagcagcagctgggccagctgacactagaaaaccttcagatgctgccagagagtgaggatgaggagagctatgacacagagtcagagttcacggagttcacagaggacgagctgccctatgatgactgtgtgtttggaggccagcgtctgacgttatgagcgcaaaggggctgaaagaacatggacttgtatatttgtacaaaaaaaaagttttatttttctaaaaaaagaaaaaagaagaaaaaatttaaagggtgtacttatatccacactgcacactgcctggcccaaaacgtcttattgtggtaggatcagccctcattttgttgcttttgtgaactttttgtaggggacgagaaagatcattgaaattctgagaaaacttcttttaaacctcacctttgtggggtttttggagaaggttatcaaaaatttcatggaaggaccacattttatatttattgtgcttcgagtgactgaccccagtggtatcctgtgacatgtaacagccaggagtgttaagcgttcagtgatgtggggtgaaaagttactacctgtcaaggtttgtgttaccctcctgtaaatggtgtacataatgtattgttggtaattattttggtacttttatgatgtatatttattaaacagatttttacaaatga

SEQ ID NO: 437440 - DNA, 2302 bp, Homo sapiens
aaaagatcaaaaaacggaaaggaccggcaggttggcaaaccccaaagagggaccgcccatcaggtcggcgtccttgggatctcagcagccgacgaccccaattcaaatcgatcgtgggaaaccccagggaaagaaggctcacttgcagagggacaggattacagggtgcaggctgcagggaagtaccggggggagggggcctggtcggaaggactttccagccactcggcgctcatcaaaaagttccctgtccgtgaccctagtggctcatcgcagggagtttctccgatgaaccccagctcagggtttaggcttctttttccccctagcagaggacgaagccagttctctttttctggtctgactggcttggaaattccccgagcctgaccccgccccagagaaatccccagccagcgtttatagggcgccgcggcggcgctgcagagcccacagcagtccgtgccgccgtcccgcccgccagcgccccagcgaggaagcagcgcgcagcccgcggcccagcgcacccgcagcagcgcccgcagctcgtccgcgccatgttccaggcggccgagcgcccccaggagtgggccatggagggcccccgcgacgggctgaagaaggagcggctactggacgaccgccacgacagcggcctggactccatgaaagacgaggagtacgagcagatggtcaaggagctgcaggagatccgcctcgagccgcaggaggtgccgcgcggctcggagccctggaagcagcagctcaccgaggacggggactcgttcctgcacttggccatcatccatgaagaaaaggcactgaccatggaagtgatccgccaggtgaagggagacctggccttcctcaacttccagaacaacctgcagcagactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtcctgcaccaccccgcacctccactccatcctgaaggctaccaactacaatggtatgtctgcctccctgccctgccccaccccctcggagggcaggtgacgtggagaaggggcaggtgggccaacttaaggagtccaggcaagagcttaaactcctaacatttggaaggttgagaaaatatgtgtgcaaagtgcctattggatgcctttataaagttctttcagaacccagactgtgggttcttaaaattcagaagataagactacttgttccataaaagaataggtgaaaggagtgagggttgaaacaggtggttatacttttttccttttgttcttccgccacacgtgtctacacttagcctctatccatggctacctgggcatcgtggagcttttggtgtccttgggtgctgatgtcaatgctcaggagccctgtaatggccggactgcccttcacctcgcagtggacctgcaaaatcctgacctggtgtcactcctgttgaagtgtggggctgatgtcaacagagttacctaccagggctattctccctaccagctcacctggggccgcccaagcacccggatacagcagcagctgggccagctgacactagaaaaccttcagatgctgccagagagtgaggatgaggagagctatgacacagagtcagagttcacggagttcacagaggacgagctgccctatgatgactgtgtgtttggaggccagcgtctgacgttatgagcgcaaaggggctgaaagaacatggacttgtatatttgtacaaaaaaaaagttttatttttctaaaaaaagaaaaaagaagaaaaaatttaaagggtgtacttatatccacactgcacactgcctggcccaaaacgtcttattgtggtaggatcagccctcattttgttgcttttgtgaactttttgtaggggacgagaaagatcattgaaattctgagaaaacttcttttaaacctcacctttgtggggtttttggagaaggttatcaaaaatttcatggaaggaccacattttatatttattgtgcttcgagtgactgaccccagtggtatcctgtgacatgtaacagccaggagtgttaagcgttcagtgatgtggggtgaaaagttactacctgtcaaggtttgtgttaccctcctgtaaatggtgtacataatgtattgttggtaattattttggtacttttatgatgtatatttattaaacagatttttacaaatga

SEQ ID NO: 437441 - DNA, 1106 bp, Homo sapiens
gcggcgcctaataattactaaattcgcggccgctcgacctgggagctggctgtgaagtccctctgctggtgcttcaagcagtttgaaggcctatacgtcgactgtgagcagggctgcctggccagcgtgggagtcctgactcagtcctgcaccaccccgcacctccactccatcctgaaggctaccaactacaatggccacacgtgtctacacttagcctctatccatggctacctgggcatcgtggagcttttggtgtccttgggtgctgatgtcaatgctcaggagccctgtaatggccggactgcccttcacctcgcagtggacctgcaaaatcctgacctggtgtcactcctgttgaagtgtggggctgatgtcaacagagttacctaccagggctattctccctaccagctcacctggggccgcccaagcacccggatacagcagcagctgggccagctgacactagaaaaccttcagatgctgccagagagtgaggatgaggagagctatgacacagagtcagagttcacggagttcacagaggacgagctgccctatgatgactgtgtgtttggaggccagcgtctgacgttatgagcgcaaaggggctgaaagaacatggacttgtatatttgtacaaaaaaaaagttttatttttctaaaaaaagaaaaaagaagaaaaaatttaaagggtgtacttatatccacactgcacactgcctggcccaaaacgtcttattgtggtaggatcagccctcattttgttgcttttgtgaactttttgtaggggacgagaaagatcattgaaattctgagaaaacttcttttaaacctcacctttgtggggtttttggagaaggttatcaaaaatttcatggaaggaccacattttatatttattgtgcttcgagtgactgaccccagtggtatcctgtgacatgtaacagccaggagtgttaagcgttcagtgatgtggggtgaaaagttactacctgtcaaggtttgtgttaccctcctgtaaatggtgtacataatgtattgttggtaattattttggtacttttatgatgtatatttattaaacagatttttacaaatga

SEQ ID NO: 437442 - DNA, 2343 bp, Homo sapiens
aaaagatcaaaaaacggaaaggaccggcaggttggcaaaccccaaagagggaccgcccatcaggtcggcgtccttgggatctcagcagccgacgaccccaattcaaatcgatcgtgggaaaccccagggaaagaaggctcacttgcagagggacaggattacagggtgcaggctgcagggaagtaccggggggagggggcctggtcggaaggactttccagccactcggcgctcatcaaaaagttccctgtccgtgaccctagtggctcatcgcagggagtttctccgatgaaccccagctcagggtttaggcttctttttccccctagcagaggacgaagccagttctctttttctggtctgactggcttggaaattccccgagcctgaccccgccccagagaaatccccagccagcgtttatagggcgccgcggcggcgctgcagagcccacagcagtccgtgccgccgtcccgcccgccagcgccccagcgaggaagcagcgcgcagcccgcggcccagcgcacccgcagcagcgcccgcagctcgtccgcgccatgttccaggcggccgagcgcccccaggagtgggccatggagggcccccgcgacgggctgaagaaggagcggctactggacgaccgccacgacagcggcctggactccatgaaagacgaggagtacgagcagatggtcaaggagctgcaggagatccgcctcgagccgcaggaggtgccgcgcggctcggagccctggaagcagcagctcaccgaggacggggactcgttcctgcacttggccatcatccatgaagaaaaggcactgaccatggaagtgatccgccaggtgaagggagacctggccttcctcaacttccagaacaacctgcagcagactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtcctgcaccaccccgcacctccactccatcctgaaggctaccaactacaatggtatgtctgcctccctgccctgccccaccccctcggagggcaggtgacgtggagaaggggcaggtgggccaacttaaggagtccaggcaagagcttaaactcctaacatttggaaggttgagaaaatatgtgtgcaaagtgcctattggatgcctttataaagttctttcagaacccagactgtgggttcttaaaattcagaagataagactacttgttccagccacacgtgtctacacttagcctctatccatggctacctgggcatcgtggagcttttggtgtccttgggtgctgatgtcaatgctcaggttggtgcttcctgcccccgacgcactgagtcaggctcctcgtgcttatgttgtgagcagaaattccaaatgcagccataagcatctcaaattccttttggtttcaggagccctgtaatggccggactgcccttcacctcgcagtggacctgcaaaatcctgacctggtgtcactcctgttgaagtgtggggctgatgtcaacagagttacctaccagggctattctccctaccagctcacctggggccgcccaagcacccggatacagcagcagctgggccagctgacactagaaaaccttcagatgctgccagagagtgaggatgaggagagctatgacacagagtcagagttcacggagttcacagaggacgagctgccctatgatgactgtgtgtttggaggccagcgtctgacgttatgagcgcaaaggggctgaaagaacatggacttgtatatttgtacaaaaaaaaagttttatttttctaaaaaaagaaaaaagaagaaaaaatttaaagggtgtacttatatccacactgcacactgcctggcccaaaacgtcttattgtggtaggatcagccctcattttgttgcttttgtgaactttttgtaggggacgagaaagatcattgaaattctgagaaaacttcttttaaacctcacctttgtggggtttttggagaaggttatcaaaaatttcatggaaggaccacattttatatttattgtgcttcgagtgactgaccccagtggtatcctgtgacatgtaacagccaggagtgttaagcgttcagtgatgtggggtgaaaagttactacctgtcaaggtttgtgttaccctcctgtaaatggtgtacataatgtattgttggtaattattttggtacttttatgatgtatatttattaaacagatttttacaaatga

SEQ ID NO: 437443 - DNA, 1111 bp, Homo sapiens
cgaaattaatcctccatgacataaatttggtatatctgtatagttaggacaaagttaagttcagaacaccgctgttgacacctaataatttatttctttttttgagacagagtcccactctgtcgcccaggctggagtgcagtgacgcagtctcggcccaccgcaacctccgctccatcctgaaggctaccaactacaatggccacacgtgtctacacttagcctctatccatggctacctgggcatcgtggagcttttggtgtccttgggtgctgatgtcaatgctcaggagccctgtaatggccggactgcccttcacctcgcagtggacctgcaaaatcctgacctggtgtcactcctgttgaagtgtggggctgatgtcaacagagttacctaccagggctattctccctaccagctcacctggggccgcccaagcacccggatacagcagcagctgggccagctgacactagaaaaccttcagatgctgccagagagtgaggatgaggagagctatgacacagagtcagagttcacggagttcacagaggacgagctgccctatgatgactgtgtgtttggaggccagcgtctgacgttatgagcgcaaaggggctgaaagaacatggacttgtatatttgtacaaaaaaaaagttttatttttctaaaaaaagaaaaaagaagaaaaaatttaaagggtgtacttatatccacactgcacactgcctggcccaaaacgtcttattgtggtaggatcagccctcattttgttgcttttgtgaactttttgtaggggacgagaaagatcattgaaattctgagaaaacttcttttaaacctcacctttgtggggtttttggagaaggttatcaaaaatttcatggaaggaccacattttatatttattgtgcttcgagtgactgaccccagtggtatcctgtgacatgtaacagccaggagtgttaagcgttcagtgatgtggggtgaaaagttactacctgtcaaggtttgtgttaccctcctgtaaatggtgtacataatgtattgttggtaattattttggtacttttatgatgtatatttattaaacagatttttacaaatga

SEQ ID NO: 437444 - DNA, 1167 bp, Homo sapiens
aaaagatcaaaaaacggaaaggaccggcaggttggcaaaccccaaagagggaccgcccatcaggtcggcgtccttgggatctcagcagccgacgaccccaattcaaatcgatcgtgggaaaccccagggaaagaaggctcacttgcagagggacaggattacagggtgcaggctgcagggaagtaccggggggagggggcctggtcggaaggactttccagccactcggcgctcatcaaaaagttccctgtccgtgaccctagtggctcatcgcagggagtttctccgatgaaccccagctcagggtttaggcttctttttccccctagcagaggacgaagccagttctctttttctggtctgactggcttggaaattccccgagcctgaccccgccccagagaaatccccagccagcgtttatagggcgccgcggcggcgctgcagagcccacagcagtccgtgccgccgtcccgcccgccagcgccccagcgaggaagcagcgcgcagcccgcggcccagcgcacccgcagcagcgcccgcagctcgtccgcgccatgttccaggcggccgagcgcccccaggagtgggccatggagggcccccgcgacgggctgaagaaggagcggctactggacgaccgccacgacagcggcctggactccatgaaagacgaggagtacgagcagatggtcaaggagctgcaggagatccgcctcgagccgcaggaggtgccgcgcggctcggagccctggaagcagcagctcaccgaggacggggactcgttcctgcacttggccatcatccatgaagaaaaggcactgaccatggaagtgatccgccaggtgaagggagacctggccttcctcaacttccagaacaacctgcagcagactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtcctgcaccaccccgcacctccactccatcctgaaggctaccaactacaatgaccacacgtgtctacacttactctatccatggctacccgactcgcctggggatccttagagtc

SEQ ID NO: 437445 - DNA, 2014 bp, Homo sapiens
aaaagatcaaaaaacggaaaggaccggcaggttggcaaaccccaaagagggaccgcccatcaggtcggcgtccttgggatctcagcagccgacgaccccaattcaaatcgatcgtgggaaaccccagggaaagaaggctcacttgcagagggacaggattacagggtgcaggctgcagggaagtaccggggggagggggcctggtcggaaggactttccagccactcggcgctcatcaaaaagttccctgtccgtgaccctagtggctcatcgcagggagtttctccgatgaaccccagctcagggtttaggcttctttttccccctagcagaggacgaagccagttctctttttctggtctgactggcttggaaattccccgagcctgaccccgccccagagaaatccccagccagcgtttatagggcgccgcggcggcgctgcagagcccacagcagtccgtgccgccgtcccgcccgccagcgccccagcgaggaagcagcgcgcagcccgcggcccagcgcacccgcagcagcgcccgcagctcgtccgcgccatgttccaggcggccgagcgcccccaggagtgggccatggagggcccccgcgacgggctgaagaaggagcggctactggacgaccgccacgacagcggcctggactccatgaaagacgaggagtacgagcagatggtcaaggagctgcaggagatccgcctcgagccgcaggaggtgccgcgcggctcggagccctggaagcagcagctcaccgaggacggggactcgttcctgcacttggccatcatccatgaagaaaaggcactgaccatggaagtgatccgccaggtgaagggagacctggccttcctcaacttccagaacaacctgcagcagactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtcctgcaccaccccgcacctccactccatcctgaaggctaccaactacaatggccacacgtgtctacacttagcctctatccatggctacctgggcatcgtggagcttttggtgtccttgggtgctgatgtcaatgctcaggagccctgtaatggccggactgcccttcacctcgcagtggacctgcaaaatcctgacctggtgtcactcctgttgaagtgtggggctgatgtcaacagagttacctaccagggctattctccctaccagctcacctggggccgcccaagcacccggatacagcagcagctgggccagctgacactagaaaaccttcagatgctgccagagagtgaggatgaggagagctatgacacagagtcagagttcacggagttcacagaggacgagctgccctatgatgactgtgtgtttggaggccagcgtctgacgttatgagcgcaaaggggctgaaagaacatggacttgtatatttgtacaaaaaaaaagttttatttttctaaaaaaagaaaaaagaagaaaaaatttaaagggtgtacttatatccacactgcacactgcctggcccaaaacgtcttattgtggtaggatcagccctcattttgttgcttttgtgaactttttgtaggggacgagaaagatcattgaaattctgagaaaacttcttttaaacctcacctttgtggggtttttggagaaggttatcaaaaatttcatggaaggaccacattttatatttattgtgcttcgagtgactgaccccagtggtatcctgtgacatgtaacagccaggagtgttaagcgttcagtgatgtggggtgaaaagttactacctgtcaaggtttgtgttaccctcctgtaaatggtgtacataatgtattgttggtaattattttggtacttttatgatgtatatttattaaacagatttttacaaatga

SEQ ID NO: 437446 - DNA, 2353 bp, Homo sapiens
  misc_feature (2332)..(2332): n is a, c, g, or t
  misc_feature (2353)..(2353): n is a, c, g, or t
aaaagatcaaaaaacggaaaggaccggcaggttggcaaaccccaaagagggaccgcccatcaggtcggcgtccttgggatctcagcagccgacgaccccaattcaaatcgatcgtgggaaaccccagggaaagaaggctcacttgcagagggacaggattacagggtgcaggctgcagggaagtaccggggggagggggcctggtcggaaggactttccagccactcggcgctcatcaaaaagttccctgtccgtgaccctagtggctcatcgcagggagtttctccgatgaaccccagctcagggtttaggcttctttttccccctagcagaggacgaagccagttctctttttctggtctgactggcttggaaattccccgagcctgaccccgccccagagaaatccccagccagcgtttatagggcgccgcggcggcgctgcagagcccacagcagtccgtgccgccgtcccgcccgccagcgccccagcgaggaagcagcgcgcagcccgcggcccagcgcacccgcagcagcgcccgcagctcgtccgcgccatgttccaggcggccgagcgcccccaggagtgggccatggagggcccccgcgacgggctgaagaaggagcggctactggacgaccgccacgacagcggcctggactccatgaaagacgaggagtacgagcagatggtcaaggagctgcaggagatccgcctcgagccgcaggaggtgccgcgcggctcggagccctggaagcagcagctcaccgaggacggggactcgttcctgcacttggccatcatccatgaagaaaaggcactgaccatggaagtgatccgccaggtgaagggagacctggccttcctcaacttccagaacaacctgcagcagactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtcctgcaccaccccgcacctccactccatcctgaaggctaccaactacaatggccacacgtgtctacacttagcctctatccatggctacctgggcatcgtggagcttttggtgtccttgggtgctgatgtcaatgctcaggagccctgtaatggccggactgcccttcacctcgcagtggacctgcaaaatcctgacctggtgtcactcctgttgaagtgtggggctgatgtcaacagagttacctaccagggctattctccctaccagctcacctggggccgcccaagcacccggatacagcagcagctgggccagctgacactagaaaaccttcagatgctgccagagagtgaggatgaggagagctatgacacagagtcagagttcacggagttcacagaggacgagctgccctatgatgactgtgtgtttggaggccagcgtctgacgttatgagcgcaaaggggctgaaagaacatggacttgtatatttgtacaaaaaaaaagttttatttttctaaaaaaagaaaaaagaagaaaaaatttaaagggtgtacttatatccacactgcacactgcctggcccaaaacgtcttattgtggtaggatcagccctcattttgttgcttttgtgaactttttgtaggggacgagaaagatcattgaaattctgagaaaacttcttttaaacctcacctttgtggggtttttggagaaggttatcaaaaatttcatggaaggaccacattttatatttattgtgcttcgagtgactgaccccagtggtatcctgtgacatgtaacagccaggagtgttaagcgttcagtgatgtggggtgaaaagttactacctgtcaaggtttgtgttaccctcctgtaaatggtgtacataatgtattgttggtaattattttggtacttttatgatgtatatttattaaacagatttttacaaatgaaaaaaaaaaaaaaaaacgggggttaattgggggggggaaaaaggggttggaattggcgcaatgggtctaaggctgtttcccggacccagtttttttgtccaggggggaaaatcgcagggtcccaaagagaggcgattaaatttcagaagccagttacctgtaaaatactcgcgaaaaaaagctaacacacagcaacgaacgcagcaccaatcacaaaaggatacagatcagcacaagacaagagccagaacatatagcagactcgcaacatcacctcaaaagaagagtagacaagatacaacatagcagtcagtcacnatctaaaaacatatttagtcn

SEQ ID NO: 437447 - DNA, 2110 bp, Homo sapiens
  misc_feature (2067)..(2067): n is a, c, g, or t
aaaagatcaaaaaacggaaaggaccggcaggttggcaaaccccaaagagggaccgcccatcaggtcggcgtccttgggatctcagcagccgacgaccccaattcaaatcgatcgtgggaaaccccagggaaagaaggctcacttgcagagggacaggattacagggtgcaggctgcagggaagtaccggggggagggggcctggtcggaaggactttccagccactcggcgctcatcaaaaagttccctgtccgtgaccctagtggctcatcgcagggagtttctccgatgaaccccagctcagggtttaggcttctttttccccctagcagaggacgaagccagttctctttttctggtctgactggcttggaaattccccgagcctgaccccgccccagagaaatccccagccagcgtttatagggcgccgcggcggcgctgcagagcccacagcagtccgtgccgccgtcccgcccgccagcgccccagcgaggaagcagcgcgcagcccgcggcccagcgcacccgcagcagcgcccgcagctcgtccgcgccatgttccaggcggccgagcgcccccaggagtgggccatggagggcccccgcgacgggctgaagaaggagcggctactggacgaccgccacgacagcggcctggactccatgaaagacgaggagtacgagcagatggtcaaggagctgcaggagatccgcctcgagccgcaggaggtgccgcgcggctcggagccctggaagcagcagctcaccgaggacggggactcgttcctgcacttggccatcatccatgaagaaaaggcactgaccatggaagtgatccgccaggtgaagggagacctggccttcctcaacttccagaacaacctgcagcagactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtcctgcaccaccccgcacctccactccatcctgaaggctaccaactacaatggccacacgtgtctacacttagcctctatccatggctacctgggcatcgtggagcttttggtgtccttgggtgctgatgtcaatgctcaggagccctgtaatggccggactgcccttcacctcgcagtggacctgcaaaatcctgacctggtgtcactcctgttgaagtgtggggctgatgtcaacagagttacctaccagggctattctccctaccagctcacctggggccgcccaagcacccggatacagcagcagctgggccagctgacactagaaaaccttcagatgctgccagagagtgaggatgaggagagctatgacacagagtcagagttcacggagttcacagaggacgagctgccctatgatgactgtgtgtttggaggccagcgtctgacgttatgagcgcaaaggggctgaaagaacatggacttgtatatttgtacaaaaaaaaagttttatttttctaaaaaaagaaaaaagaagaaaaaatttaaagggtgtacttatatccacactgcacactgcctggcccaaaacgtcttattgtggtaggatcagccctcattttgttgcttttgtgaactttttgtaggggacgagaaagatcattgaaattctgagaaaacttcttttaaacctcacctttgtggggtttttggagaaggttatcaaaaatttcatggaaggaccacattttatatttattgtgcttcgagtgactgaccccagtggtatcctgtgacatgtaacagccaggagtgttaagcgttcagtgatgtggggtgaaaagttactacctgtcaaggtttgtgttaccctcctgtaaatggtgtacataatgtattgttggtaattattttggtacttttatgatgtatatttattaaacagatttttacaaatgaaaaaaaaaaaaaaaaaaaaaaaaaaaaaaaaaaaaaaaaaaaaaaaaaaaaanaggaggggggcgcgcgcccgagacccccccgggggggcgccca

SEQ ID NO: 437448 - DNA, 1996 bp, Homo sapiens
aaaagatcaaaaaacggaaaggaccggcaggttggcaaaccccaaagagggaccgcccatcaggtcggcgtccttgggatctcagcagccgacgaccccaattcaaatcgatcgtgggaaaccccagggaaagaaggctcacttgcagagggacaggattacagggtgcaggctgcagggaagtaccggggggagggggcctggtcggaaggactttccagccactcggcgctcatcaaaaagttccctgtccgtgaccctagtggctcatcgcagggagtttctccgatgaaccccagctcagggtttaggcttctttttccccctagcagaggacgaagccagttctctttttctggtctgactggcttggaaattccccgagcctgaccccgccccagagaaatccccagccagcgtttatagggcgccgcggcggcgctgcagagcccacagcagtccgtgccgccgtcccgcccgccagcgccccagcgaggaagcagcgcgcagcccgcggcccagcgcacccgcagcagcgcccgcagctcgtccgcgccatgttccaggcggccgagcgcccccaggagtgggccatggagggcccccgcgacgggctgaagaaggagcggctactggacgaccgccacgacagcggcctggactccatgaaagacgaggagtacgagcagatggtcaaggagctgcaggagatccgcctcgagccgcaggaggtgccgcgcggctcggagccctggaagcagcagctcaccgaggacggggactcgttcctgcacttggccatcatccatgaagaaaaggcactgaccatggaagtgatccgccaggtgaagggagacctggccttcctcaacttccagaacaacctgcagcagactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtcctgcaccaccccgcacctccactccatcctgaaggctaccaactacaatggccacacgtgtctacacttagcctctatccatggctacctgggcatcgtggagcttttggtgtccttgggtgctgatgtcaatgctcaggagccctgtaatggccggactgcccttcacctcgcagtggacctgcaaaatcctgacctggtgtcactcctgttgaagtgtggggctgatgtcaacagagttacctaccagggctattctccctaccagctcacctggggccgcccaagcacccggatacagcagcagctgggccagctgacactagaaaaccttcagatgctgccagagagtgaggatgaggagagctatgacacagagtcagagttcacggagttcacagaggacgagctgccctatgatgactgtgtgtttggaggccagcgtctgacgttatgagcgcaaaggggctgaaagaacatggacttgtatatttgtacaaaaaaaaagttttatttttctaaaaaaagaaaaaagaagaaaaaatttaaagggtgtacttatatccacactgcacactgcctggcccaaaacgtcttattgtggtaggatcagccctcattttgttgcttttgtgaactttttgtaggggacgagaaagatcattgaaattctgagaaaacttcttttaaacctcacctttgtggggtttttggagaaggttatcaaaaatttcatggaaggaccacattttatatttattgtgcttcgagtgactgaccccagtggtatcctgtgacatgtaacagccaggagtgttaagcgttcagtgatgtggggtgaaaagttactacctgtcaaggtttgtgttaccataatgtattgttggtaattattttggtacttttatgatgtatatttattaaacagatttttacaaatga

SEQ ID NO: 437449 - DNA, 1321 bp, Homo sapiens
cggccttgcgcaatcccccgcagcccgcgcctccctgggccccacgcggtgcactcaccacccctggggtttttccctctcttccccacaggttcctgcacttggccatcatccatgaagaaaaggcactgaccatggaagtgatccgccaggtgaagggagacctggccttcctcaacttccagaacaacctgcagcagactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtcctgcaccaccccgcacctccactccatcctgaaggctaccaactacaatggccacacgtgtctacacttagcctctatccatggctacctgggcatcgtggagcttttggtgtccttgggtgctgatgtcaatgctcaggagccctgtaatggccggactgcccttcacctcgcagtggacctgcaaaatcctgacctggtgtcactcctgttgaagtgtggggctgatgtcaacagagttacctaccagggctattctccctaccagctcacctggggccgcccaagcacccggatacagcagcagctgggccagctgacactagaaaaccttcagatgctgccagagagtgaggatgaggagagctatgacacagagtcagagttcacggagttcacagaggacgagctgccctatgatgactgtgtgtttggaggccagcgtctgacgttatgagcgcaaaggggctgaaagaacatggacttgtatatttgtacaaaaaaaaagttttatttttctaaaaaaagaaaaaagaagaaaaaatttaaagggtgtacttatatccacactgcacactgcctggcccaaaacgtcttattgtggtaggatcagccctcattttgttgcttttgtgaactttttgtaggggacgagaaagatcattgaaattctgagaaaacttcttttaaacctcacctttgtggggtttttggagaaggttatcaaaaatttcatggaaggaccacattttatatttattgtgcttcgagtgactgaccccagtggtatcctgtgacatgtaacagccaggagtgttaagcgttcagtgatgtggggtgaaaagttactacctgtcaaggtttgtgttaccctcctgtaaatggtgtacataatgtattgttggtaattattttggtacttttatgatgtatatttattaaacagatttttacaaatga

SEQ ID NO: 437450 - DNA, 1961 bp, Homo sapiens
aaaagatcaaaaaacggaaaggaccggcaggttggcaaaccccaaagagggaccgcccatcaggtcggcgtccttgggatctcagcagccgacgaccccaattcaaatcgatcgtgggaaaccccagggaaagaaggctcacttgcagagggacaggattacagggtgcaggctgcagggaagtaccggggggagggggcctggtcggaaggactttccagccactcggcgctcatcaaaaagttccctgtccgtgaccctagtggctcatcgcagggagtttctccgatgaaccccagctcagggtttaggcttctttttccccctagcagaggacgaagccagttctctttttctggtctgactggcttggaaattccccgagcctgaccccgccccagagaaatccccagccagcgtttatagggcgccgcggcggcgctgcagagcccacagcagtccgtgccgccgtcccgcccgccagcgccccagcgaggaagcagcgcgcagcccgcggcccagcgcacccgcagcagcgcccgcagctcgtccgcgccatgttccaggcggccgagcgcccccaggagtgggccatggagggcccccgcgacgggctgaagaaggagcggctactggacgaccgccacgacagcggcctggactccatgaaagacgaggagtacgagcagatggtcaaggagctgcaggagatccgcctcgagccgcaggaggtgccgcgcggctcggagccctggaagcagcagctcaccgaggacggggactcgttcctgcacttggccatcatccatgaagaaaaggcactgaccatggaagtgatccgccaggtgaagggagacctggccttcctcaacttccagaacaacctgcagcagactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtcctgcaccaccccgcacctccactccatcctgaaggctaccaactacaatggccacacgtgtctacacttagcctctatccatggctacctgggcatcgtggagcttttggtgtccttgggtgctgatgtcaatgctcaggagccctgtaatggccggactgcccttcacctcgcagtggacctgcaaaatcctgacctggtgtcactcctgttgaagtgtggggctgatgtcaacagagttacctaccagggctattctccctaccagctcacctggggccgcccaagcacccggatacagcagcagctgggccagctgacactagtcagagttcacggagttcacagaggacgagctgccctatgatgactgtgtgtttggaggccagcgtctgacgttatgagcgcaaaggggctgaaagaacatggacttgtatatttgtacaaaaaaaaagttttatttttctaaaaaaagaaaaaagaagaaaaaatttaaagggtgtacttatatccacactgcacactgcctggcccaaaacgtcttattgtggtaggatcagccctcattttgttgcttttgtgaactttttgtaggggacgagaaagatcattgaaattctgagaaaacttcttttaaacctcacctttgtggggtttttggagaaggttatcaaaaatttcatggaaggaccacattttatatttattgtgcttcgagtgactgaccccagtggtatcctgtgacatgtaacagccaggagtgttaagcgttcagtgatgtggggtgaaaagttactacctgtcaaggtttgtgttaccctcctgtaaatggtgtacataatgtattgttggtaattattttggtacttttatgatgtatatttattaaacagatttttacaaatga

SEQ ID NO: 437451 - DNA, 2121 bp, Homo sapiens
aaaagatcaaaaaacggaaaggaccggcaggttggcaaaccccaaagagggaccgcccatcaggtcggcgtccttgggatctcagcagccgacgaccccaattcaaatcgatcgtgggaaaccccagggaaagaaggctcacttgcagagggacaggattacagggtgcaggctgcagggaagtaccggggggagggggcctggtcggaaggactttccagccactcggcgctcatcaaaaagttccctgtccgtgaccctagtggctcatcgcagggagtttctccgatgaaccccagctcagggtttaggcttctttttccccctagcagaggacgaagccagttctctttttctggtctgactggcttggaaattccccgagcctgaccccgccccagagaaatccccagccagcgtttatagggcgccgcggcggcgctgcagagcccacagcagtccgtgccgccgtcccgcccgccagcgccccagcgaggaagcagcgcgcagcccgcggcccagcgcacccgcagcagcgcccgcagctcgtccgcgccatgttccaggcggccgagcgcccccaggagtgggccatggagggcccccgcgacgggctgaagaaggagcggctactggacgaccgccacgacagcggcctggactccatgaaagacgaggagtacgagcagatggtcaaggagctgcaggagatccgcctcgagccgcaggaggtgccgcgcggctcggagccctggaagcagcagctcaccgaggacggggactcgttcctgcacttggccatcatccatgaagaaaaggcactgaccatggaagtgatccgccaggtgaagggagacctggccttcctcaacttccagaacaacctgcagcagactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtcctgcaccaccccgcacctccactccatcctgaaggctaccaactacaatggccacacgtgtctacacttagcctctatccatggctacctgggcatcgtggagcttttggtgtccttgggtgctgatgtcaatgctcaggttggtgcttcctgcccccgacgcactgagtcaggctcctcgtgcttatgttgtgagcagaaattccaaatgcagccataagcatctcaaattccttttggtttcaggagccctgtaatggccggactgcccttcacctcgcagtggacctgcaaaatcctgacctggtgtcactcctgttgaagtgtggggctgatgtcaacagagttacctaccagggctattctccctaccagctcacctggggccgcccaagcacccggatacagcagcagctgggccagctgacactagaaaaccttcagatgctgccagagagtgaggatgaggagagctatgacacagagtcagagttcacggagttcacagaggacgagctgccctatgatgactgtgtgtttggaggccagcgtctgacgttatgagcgcaaaggggctgaaagaacatggacttgtatatttgtacaaaaaaaaagttttatttttctaaaaaaagaaaaaagaagaaaaaatttaaagggtgtacttatatccacactgcacactgcctggcccaaaacgtcttattgtggtaggatcagccctcattttgttgcttttgtgaactttttgtaggggacgagaaagatcattgaaattctgagaaaacttcttttaaacctcacctttgtggggtttttggagaaggttatcaaaaatttcatggaaggaccacattttatatttattgtgcttcgagtgactgaccccagtggtatcctgtgacatgtaacagccaggagtgttaagcgttcagtgatgtggggtgaaaagttactacctgtcaaggtttgtgttaccctcctgtaaatggtgtacataatgtattgttggtaattattttggtacttttatgatgtatatttattaaacagatttttacaaatga

SEQ ID NO: 437452 - DNA, 2409 bp, Homo sapiens
aaaagatcaaaaaacggaaaggaccggcaggttggcaaaccccaaagagggaccgcccatcaggtcggcgtccttgggatctcagcagccgacgaccccaattcaaatcgatcgtgggaaaccccagggaaagaaggctcacttgcagagggacaggattacagggtgcaggctgcagggaagtaccggggggagggggcctggtcggaaggactttccagccactcggcgctcatcaaaaagttccctgtccgtgaccctagtggctcatcgcagggagtttctccgatgaaccccagctcagggtttaggcttctttttccccctagcagaggacgaagccagttctctttttctggtctgactggcttggaaattccccgagcctgaccccgccccagagaaatccccagccagcgtttatagggcgccgcggcggcgctgcagagcccacagcagtccgtgccgccgtcccgcccgccagcgccccagcgaggaagcagcgcgcagcccgcggcccagcgcacccgcagcagcgcccgcagctcgtccgcgccatgttccaggcggccgagcgcccccaggagtgggccatggagggcccccgcgacgggctgaagaaggagcggctactggacgaccgccacgacagcggcctggactccatgaaagacgaggagtacgagcagatggtcaaggagctgcaggagatccgcctcgagccgcaggaggtgccgcgcggctcggagccctggaagcagcagctcaccgaggacggggactcgttcctgcacttggccatcatccatgaagaaaaggcactgaccatggaagtgatccgccaggtgaagggagacctggccttcctcaacttccagaacaacctgcagcagactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtcctgcaccaccccgcacctccactccatcctgaaggctaccaactacaatggtatgtctgcctccctgccctgccccaccccctcggagggcaggtgacgtggagaaggggcaggtgggccaacttaaggagtccaggcaagagcttaaactcctaacatttggaaggttgagaaaatatgtgtgcaaagtgcctattggatgcctttataaagttctttcagaacccagactgtgggttcttaaaattcagaagataagactacttgttccataaaagaataggtgaaaggagtgagggttgaaacaggtggttatacttttttccttttgttcttccgccacacgtgtctacacttagcctctatccatggctacctgggcatcgtggagcttttggtgtccttgggtgctgatgtcaatgctcaggttggtgcttcctgcccccgacgcactgagtcaggctcctcgtgcttatgttgtgagcagaaattccaaatgcagccataagcatctcaaattccttttggtttcaggagccctgtaatggccggactgcccttcacctcgcagtggacctgcaaaatcctgacctggtgtcactcctgttgaagtgtggggctgatgtcaacagagttacctaccagggctattctccctaccagctcacctggggccgcccaagcacccggatacagcagcagctgggccagctgacactagaaaaccttcagatgctgccagagagtgaggatgaggagagctatgacacagagtcagagttcacggagttcacagaggacgagctgccctatgatgactgtgtgtttggaggccagcgtctgacgttatgagcgcaaaggggctgaaagaacatggacttgtatatttgtacaaaaaaaaagttttatttttctaaaaaaagaaaaaagaagaaaaaatttaaagggtgtacttatatccacactgcacactgcctggcccaaaacgtcttattgtggtaggatcagccctcattttgttgcttttgtgaactttttgtaggggacgagaaagatcattgaaattctgagaaaacttcttttaaacctcacctttgtggggtttttggagaaggttatcaaaaatttcatggaaggaccacattttatatttattgtgcttcgagtgactgaccccagtggtatcctgtgacatgtaacagccaggagtgttaagcgttcagtgatgtggggtgaaaagttactacctgtcaaggtttgtgttaccctcctgtaaatggtgtacataatgtattgttggtaattattttggtacttttatgatgtatatttattaaacagatttttacaaatga

SEQ ID NO: 437453 - DNA, 1343 bp, Homo sapiens
aaaagatcaaaaaacggaaaggaccggcaggttggcaaaccccaaagagggaccgcccatcaggtcggcgtccttgggatctcagcagccgacgaccccaattcaaatcgatcgtgggaaaccccagggaaagaaggctcacttgcagagggacaggattacagggtgcaggctgcagggaagtaccggggggagggggcctggtcggaaggactttccagccactcggcgctcatcaaaaagttccctgtccgtgaccctagtggctcatcgcagggagtttctccgatgaaccccagctcagggtttaggcttctttttccccctagcagaggacgaagccagttctctttttctggtctgactggcttggaaattccccgagcctgaccccgccccagagaaatccccagccagcgtttatagggcgccgcggcggcgctgcagagcccacagcagtccgtgccgccgtcccgcccgccagcgccccagcgaggaagcagcgcgcagcccgcggcccagcgcacccgcagcagcgcccgcagctcgtccgcgccatgttccaggcggccgagcgcccccaggagtgggccatggagggcccccgcgacgggctgaagaaggagcggctactggacgaccgccacgacagcggcctggactccatgaaagacgaggagtacgagcagatggtcaaggagctgcaggagatccgcctcgagccgcaggaggtgccgcgcggctcggagccctggaagcagcagctcaccgaggacggggactcgttcctgcacttggccatcatccatgaagaaaaggcactgaccatggaagtgatccgccaggtgaagggagacctggccttcctcaacttccagaacaacctgcagcagactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtcctgcaccaccccgcacctccactccatcctgaaggctaccaactacaatggccacacgtgtctacacttagcctctatccatggctacctgggcatcgtggagcttttggtgtccttgggtgctgatgtcaatgctcaggagccctgtaatggccggactgcccttcacctcgcagtggacctgcaaaatcctgacctggtgtcactcctgttgaagtgtggggctgatgtcaacagagttacctaccaggtcgacgcggccgcgaatttagtagtagtaatagtagta

SEQ ID NO: 437454 - DNA, 4366 bp, Homo sapiens
  misc_feature (29)..(29): n is a, c, g, or t
  misc_feature (33)..(33): n is a, c, g, or t
cggcccgaggtcctgtgggaagtgagganctcnggacgggggcggggctccgacagaggcggcgattgtggcggcccatttgtaaatgctgcggagattgaggtgtcggttcgtgctgctgagctgcccaggcttcacggagcggtgttggaaatcaatagctcttctagcctttgcattgtttaaatataatagtgtcattggactaagatgttcctgatgccaacctcttcagagttaaacagtgggcagaacttcctaacccagtggatgaccaatccttctcgggctggggtcatattaaatcgtggatttcctattttggaagcagacaaagagaagcgagcagctgtggacatttctaccagctttcctattaaaggcacacatttttctgatagcttcagctttataaatgaagaagattcacttcttgaagaacagaagttggagtcaaacaacccttacaaaccacagtcagataaatctgaaacccatacagcctttccttgcattaaaaagggaccacaggtagcggcatgtcacagtgctcctggacaccaggaagaaaacaaaaatgacttcatcccagatcttgcgagtgaattcaaagaaggggcttataaagacccactttttaaaaaacttgaacagctgaaagaagtacaacagaagaagcaggaacaattgaagaggcaacagttggagcaactacagagactcatggaagaacaagagaagctgctcaccatggtgtctgggcagtgcacacttccaggtttgagtttactgcctgatgatcagagccagaagcacaggtctccaggaaataccaccactggagagagagccacatgctgcttcccatcatatgtctacccggacccaacccaggaagaaacatacccgtccaacattttatcccatgagcaaagcaacttctgtagaactgctcatggagattttgtcttaacttcaaaacgtgcgtctcctaatttattttctgaggcacagtatcaagaagcacctgtggaaaaaaataatttaaaagaagaaaaccgtaaccatcctacaggagaaagtatcttatgttgggagaaagtgacagaacagattcaggaagcaaatgataagaacttacaaaaacatgatgattcctcagaagtggctaatattgaagaaaggcccattaaagctgctattggagaaaggaaacagacctttgaagattacttagaagaacaaattcagttggaagagcaagaactgaagcaaaaacagctgaaggaagcagaaggaccattgccaatcaaagcaaaaccaaaacaaccatttttaaaacgaggagaaggtttagctagatttactaatgccaaatctaagtttcaaaaaggcaaagaaagtaaactagtgactaaccagagcacttccgaggaccagccgctgtttaaaatggatagacagcaactccagcggaaaaccgctcttaaaaataaagagctgtgtgcagacaaccctatccttaaaaaggacagtaaagctagaaccaagagtggttctgtcaccctcagtcagaagccgaaaatgctgaagtgtagtaacaggaaaagtctttctccgtcaggattgaaaatacagacggggaagaaatgtgatgggcagtttagagaccagatcaaatttgaaaacaaagtcacatctaataataaagaaaatgtaactgagtgtccaaaaccttgcgatactggctgcacagggtggaataagacacaaggtaaagacagacttcctctttcaacagggccggccagccggctggctgctaagagccccataagggagaccatgaaagagtctgaatcttctcttgacgtttctcttcagaaaaagttagagacttgggaacgagaaaaggaaaaggaaaatttggaattagatgaatttttgtttttagaacaagctgctgatgaaatatcattttctagtaattcctcatttgtactgaaaatcttagaaagggatcaacagatctgcaaaggtcaccggatgtcttccacccctgtcaaagctgtgccacagaagacaaatccggcagatcccattagtcattgtaaccgcagtgaggatttggaccacactgcacgtgagaaggagagtgagtgtgaagtcgcacccaaacaacttcattcattgtcctcagctgatgaattgagggaacagccttgtaaaatcaggaaagccgtccaaaagagcacttctgaaaatcagactgaatggaatgcacgtgacgatgaaggtgttccaaatagtgacagtagcactgactctgaggaacagcttgatgttaccataaaaccatcgactgaggatagagagaggggcatcagcagcagagaggatagcccacaagtctgtgatgataaggggccttttaaggacaccaggacccaagaagataaaaggagagatgttgatctggatttgtctgataaagattacagtagcgatgagtctatcatggaaagcataaaacataaagtgtctgagccctcgagatcctcatccctaagtctgagtaaaatggactttgatgatgaaagaacttggactgaccttgaagagaatttgtgtaaccatgatgttgttcttgggaatgaatccacttatgggacgccgcagacatgctaccctaataatgaaataggtatcctggacaaaacaataaaaaggaagattgcaccagtcaagaggggagaagacttgagcaagtccaggaggagcagaagtcctcctacatcggagctgatgatgaaattctttccttctttgaaaccaaaaccaaagtcagattcacacttgggaaatgaactcaagttaaacataagtcaagaccaaccacctggtgacaatgctcgatcccaggttttgagagagaaaattattgaattggaaacagaaatagaaaagtttaaagctgagaacgcatctttagctaaacttcgcattgaacgagaaagtgccttggaaaaactcaggaaagaaattgcagacttcgaacaacagaaagcaaaagaattagctcgaatagaagagtttaaaaaggaggagatgaggaagctacaaaaggaacgtaaagtttttgaaaagtatactacagctgcaagaacttttccagataaaaaggaacgtgaagaaatacaggactttaaaacagcaaatagcagatttacgggaagatttgaaaagaaaggagaccaaatggtcaagtacacacagccgtctcagaagccagatacaaatgttagtcagagagaacacagacctccgggaagaaataaaagtgatggaaagattccgactggatgcctggaagagagcagaagccatagagagcagcctcgaggtggagaagaaggacaagcttgcgaacacatctgttcgatttcaaaacagtcagatttcttcaggaacccaggtagaaaaatacaagaaaaattatcttccaatgcaaggcaatccacctcgaagatccaagtctgcacctcctcgtgatttaggcaatttggataagggacaagctgcctctcccagggagccacttgaaccactgaacttcccagatcctgaatataaagaggaggaggaagaccaagacatacagggagaaatcagtcatcctgatggaaaggtggaaaaggtttataagaatgggtgccgtgttatactgtttcccaatggaactcgaaaggaagtgagtgcagatgggaagaccatcactgtcactttctttaatggtgacgtgaagcaggtcatgccagaccaaagagtgatctactactatgcagctgcccagaccactcacacgacatacccggagggactggaagtcttacatttctcaagtggacaaatagaaaaacattacccagatggaagaaaagaaatcacgtttcctgaccagactgttaaaaacttatttcctgatggacaagaagaaagcattttcccagatggtacaattgtcagagtacaacgtgatggcaacaaactcatagagtttaataatggccaaagagaactacatactgcccagttcaagagacgggaatacccagatggcactgttaaaaccgtatatgcaaacggtcatcaagaaacgaagtacagatccggtcggataagagttaaggacaaggagggtaatgtgctaatggacacggagctgtgacgatcctcatgtgatcatgaagtaacagtaactgactttttatgttaaaaaatgtacatttactgtggattctgtttaatttattgtgtatgtgtggggaaaagattggattctaaaataaaagtttaccctgtggca

SEQ ID NO: 437455 - DNA, 422 bp, Homo sapiens
agactcaaaaggctacttttcagtagtttttctgttgtttattttctattattttttttttaagaaatcatattttttttaaattttacagtgatggcaacaaactcatagagtttaataatggccaaagagaactacatactgcccagttcaagagacgggaatacccagatggcactgttaaaaccgtatatgcaaacggtcatcaagaaacgaagtacagatccggtcggataagagttaaggacaaggagggtaatgtgctaatggacacggagctgtgacgatcctcatgtgatcatgaagtaacagtaactgactttttatgttaaaaaatgtacatttactgtggattctgtttaatttattgtgtatgtgtggggaaaagattggattctaaaataaaagtttaccctgtggca

SEQ ID NO: 437456 - DNA, 5081 bp, Homo sapiens
  misc_feature (29)..(29): n is a, c, g, or t
  misc_feature (33)..(33): n is a, c, g, or t
cggcccgaggtcctgtgggaagtgagganctcnggacgggggcggggctccgacagaggcggcgattgtggcggcccatttgtaaatgctgcggagattgaggtgtcggttcgtgctgctgagctgcccaggcttcacggagcggtgttggaaatcaatagctcttctagcctttgcattgtttaaatataatagtgtcattggactaagatgttcctgatgccaacctcttcagagttaaacagtgggcagaacttcctaacccagtggatgaccaatccttctcgggctggggtcatattaaatcgtggatttcctattttggaagcagacaaagagaagcgagcagctgtggacatttctaccagctttcctattaaaggcacacatttttctgatagcttcagctttataaatgaagaagattcacttcttgaagaacagaagttggagtcaaacaacccttacaaaccacagtcagataaatctgaaacccatacagcctttccttgcattaaaaagggaccacaggtagcggcatgtcacagtgctcctggacaccaggaagaaaacaaaaatgacttcatcccagatcttgcgagtgaattcaaagaaggggcttataaagacccactttttaaaaaacttgaacagctgaaagaagtacaacagaagaagcaggaacaattgaagaggcaacagttggagcaactacagagactcatggaagaacaagagaagctgctcaccatggtgtctgggcagtgcacacttccaggtttgagtttactgcctgatgatcagagccagaagcacaggtctccaggaaataccaccactggagagagagccacatgctgcttcccatcatatgtctacccggacccaacccaggaagaaacatacccgtccaacattttatcccatgagcaaagcaacttctgtagaactgctcatggagattttgtcttaacttcaaaacgtgcgtctcctaatttattttctgaggcacagtatcaagaagcacctgtggaaaaaaataatttaaaagaagaaaaccgtaaccatcctacaggagaaagtatcttatgttgggagaaagtgacagaacagattcaggaagcaaatgataagaacttacaaaaacatgatgattcctcagaagtggctaatattgaagaaaggcccattaaagctgctattggagaaaggaaacagacctttgaagattacttagaagaacaaattcagttggaagagcaagaactgaagcaaaaacagctgaaggaagcagaaggaccattgccaatcaaagcaaaaccaaaacaaccatttttaaaacgaggagaaggtttagctagatttactaatgccaaatctaagtttcaaaaaggcaaagaaagtaaactagtgactaaccagagcacttccgaggaccagccgctgtttaaaatggatagacagcaactccagcggaaaaccgctcttaaaaataaagagctgtgtgcagacaaccctatccttaaaaaggacagtaaagctagaaccaagagtggttctgtcaccctcagtcagaagccgaaaatgctgaagtgtagtaacaggaaaagtctttctccgtcaggattgaaaatacagacggggaagaaatgtgatgggcagtttagagaccagatcaaatttgaaaacaaagtcacatctaataataaagaaaatgtaactgagtgtccaaaaccttgcgatactggctgcacagggtggaataagacacaaggtaaagacagacttcctctttcaacagggccggccagccggctggctgctaagagccccataagggagaccatgaaagagtctgaatcttctcttgacgtttctcttcagaaaaagttagagacttgggaacgagaaaaggaaaaggaaaatttggaattagatgaatttttgtttttagaacaagctgctgatgaaatatcattttctagtaattcctcatttgtactgaaaatcttagaaagggatcaacagatctgcaaaggtcaccggatgtcttccacccctgtcaaagctgtgccacagaagacaaatccggcagatcccattagtcattgtaaccgcagtgaggatttggaccacactgcacgtgagaaggagagtgagtgtgaagtcgcacccaaacaacttcattcattgtcctcagctgatgaattgagggaacagccttgtaaaatcaggaaagccgtccaaaagagcacttctgaaaatcagactgaatggaatgcacgtgacgatgaaggtgttccaaatagtgacagtagcactgactctgaggaacagcttgatgttaccataaaaccatcgactgaggatagagagaggggcatcagcagcagagaggatagcccacaagtctgtgatgataaggggccttttaaggacaccaggacccaagaagataaaaggagagatgttgatctggatttgtctgataaagattacagtagcgatgagtctatcatggaaagcataaaacataaagtgtctgagccctcgagatcctcatccctaagtctgagtaaaatggactttgatgatgaaagaacttggactgaccttgaagagaatttgtgtaaccatgatgttgttcttgggaatgaatccacttatgggacgccgcagacatgctaccctaataatgaaataggtatcctggacaaaacaataaaaaggaagattgcaccagtcaagaggggagaagacttgagcaagtccaggaggagcagaagtcctcctacatcggagctgatgatgaaattctttccttctttgaaaccaaaaccaaagtcagattcacacttgggaaatgaactcaagttaaacataagtcaagaccaaccacctggtgacaatgctcgatcccaggttttgagagagaaaattattgaattggaaacagaaatagaaaagtttaaagctgagaacgcatctttagctaaacttcgcattgaacgagaaagtgccttggaaaaactcaggaaagaaattgcagacttcgaacaacagaaagcaaaagaattagctcgaatagaagagtttaaaaaggaggagatgaggaagctacaaaaggaacgtaaagtttttgaaaagtatactacagctgcaagaacttttccagataaaaaggaacgtgaagaaatacaggactttaaaacagcaaatagcagatttacgggaagatttgaaaagaaaggagaccaaatggtcaagtacacacagccgtctcagaagccagatacaaatgttagtcagagagaacacagacctccgggaagaaataaaagtgatggaaagattccgactggatgcctggaagagagcagaagccatagagagcagcctcgaggtggagaagaaggacaagcttgcgaacacatctgttcgatttcaaaacagtcagatttcttcaggaacccaggtagaaaaatacaagaaaaattatcttccaatgcaaggcacagcacagccgcctcacacgcccagcagcttgttggctgaccacctgcctccgctctcctccttcaggccattctcccgtaacatccagctccgttacactttttaacatggaggtcagattctggcacttgctcgagacccttccaagttgagtgtttacaatatgatccattggcacataggatgaaaatactggcacttcagtgtatttttagagagagattcacctcactttgttgttggtgggggcgtgtttattttgtaatgtatatgttgctggtacagtatgtgattggtgtgctggacatattacaaaaagtttataccatagccacaagggcatttatgttttaactaaatacccagttatttggtgaagccaaattccacaggtcttagatgcctcttttatctgcaccttacaccttgtgattgtctctgaaatacatttgggtctgtcaggctgtttcatcacctgtctcttccccaggattgtaaactctgagacaagatactgtctttcttggacatctaggacttaagtacctgtgtcggagaactacaaattagtaaagaaaaatattaagacatccttaactaatggataaaggacagcagttcacaggatatgaactaaggaaatgtgtgatcatactaataaaattttcaattaaatattaaatctaactcttgacaattttattctaataggcaatccacctcgaagatccaagtctgcacctcctcgtgatttaggcaatttggataagggacaagctgcctctcccagggagccacttgaaccactgaacttcccagatcctgaatataaagaggaggaggaagaccaagacatacagggagaaatcagtcatcctgatggaaaggtggaaaaggtttataagaatgggtgccgtgttatactgtttcccaatggaactcgaaaggaagtgagtgcagatgggaagaccatcactgtcactttctttaatggtgacgtgaagcaggtcatgccagaccaaagagtgatctactactatgcagctgcccagaccactcacacgacatacccggagggactggaagtcttacatttctcaagtggacaaatagaaaaacattacccagatggaagaaaagaaatcacgtttcctgaccagactgttaaaaacttatttcctgatggacaagaagaaagcattttcccagatggtacaattgtcagagtacaacgtgatggcaacaaactcatagagtttaataatggccaaagagaactacatactgcccagttcaagagacgggaatacccagatggcactgttaaaaccgtatatgcaaacggtcatcaagaaacgaagtacagatccggtcggataagagttaaggacaaggagggtaatgtgctaatggacacggagctgtgacgatcctcatgtgatcatgaagtaacagtaactgactttttatgttaaaaaatgtacatttactgtggattctgtttaatttattgtgtatgtgtggggaaaagattggattctaaaataaaagtttaccctgtggca

SEQ ID NO: 437457 - DNA, 4190 bp, Homo sapiens
  misc_feature (29)..(29): n is a, c, g, or t
  misc_feature (33)..(33): n is a, c, g, or t
cggcccgaggtcctgtgggaagtgagganctcnggacgggggcggggctccgacagaggcggcgattgtggcggcccatttgtaaatgctgcggagattgaggtgtcggttcgtgctgctgagctgcccaggcttcacggagcgtttggaagcagacaaagagaagcgagcagctgtggacatttctaccagctttcctattaaaggcacacatttttctgatagcttcagctttataaatgaagaagattcacttcttgaagaacagaagttggagtcaaacaacccttacaaaccacagtcagataaatctgaaacccatacagcctttccttgcattaaaaagggaccacaggtagcggcatgtcacagtgctcctggacaccaggaagaaaacaaaaatgacttcatcccagatcttgcgagtgaattcaaagaaggggcttataaagacccactttttaaaaaacttgaacagctgaaagaagtacaacagaagaagcaggaacaattgaagaggcaacagttggagcaactacagagactcatggaagaacaagagaagctgctcaccatggtgtctgggcagtgcacacttccaggtttgagtttactgcctgatgatcagagccagaagcacaggtctccaggaaataccaccactggagagagagccacatgctgcttcccatcatatgtctacccggacccaacccaggaagaaacatacccgtccaacattttatcccatgagcaaagcaacttctgtagaactgctcatggagattttgtcttaacttcaaaacgtgcgtctcctaatttattttctgaggcacagtatcaagaagcacctgtggaaaaaaataatttaaaagaagaaaaccgtaaccatcctacaggagaaagtatcttatgttgggagaaagtgacagaacagattcaggaagcaaatgataagaacttacaaaaacatgatgattcctcagaagtggctaatattgaagaaaggcccattaaagctgctattggagaaaggaaacagacctttgaagattacttagaagaacaaattcagttggaagagcaagaactgaagcaaaaacagctgaaggaagcagaaggaccattgccaatcaaagcaaaaccaaaacaaccatttttaaaacgaggagaaggtttagctagatttactaatgccaaatctaagtttcaaaaaggcaaagaaagtaaactagtgactaaccagagcacttccgaggaccagccgctgtttaaaatggatagacagcaactccagcggaaaaccgctcttaaaaataaagagctgtgtgcagacaaccctatccttaaaaaggacagtaaagctagaaccaagagtggttctgtcaccctcagtcagaagccgaaaatgctgaagtgtagtaacaggaaaagtctttctccgtcaggattgaaaatacagacggggaagaaatgtgatgggcagtttagagaccagatcaaatttgaaaacaaagtcacatctaataataaagaaaatgtaactgagtgtccaaaaccttgcgatactggctgcacagggtggaataagacacaaggtaaagacagacttcctctttcaacagggccggccagccggctggctgctaagagccccataagggagaccatgaaagagtctgaatcttctcttgacgtttctcttcagaaaaagttagagacttgggaacgagaaaaggaaaaggaaaatttggaattagatgaatttttgtttttagaacaagctgctgatgaaatatcattttctagtaattcctcatttgtactgaaaatcttagaaagggatcaacagatctgcaaaggtcaccggatgtcttccacccctgtcaaagctgtgccacagaagacaaatccggcagatcccattagtcattgtaaccgcagtgaggatttggaccacactgcacgtgagaaggagagtgagtgtgaagtcgcacccaaacaacttcattcattgtcctcagctgatgaattgagggaacagccttgtaaaatcaggaaagccgtccaaaagagcacttctgaaaatcagactgaatggaatgcacgtgacgatgaaggtgttccaaatagtgacagtagcactgactctgaggaacagcttgatgttaccataaaaccatcgactgaggatagagagaggggcatcagcagcagagaggatagcccacaagtctgtgatgataaggggccttttaaggacaccaggacccaagaagataaaaggagagatgttgatctggatttgtctgataaagattacagtagcgatgagtctatcatggaaagcataaaacataaagtgtctgagccctcgagatcctcatccctaagtctgagtaaaatggactttgatgatgaaagaacttggactgaccttgaagagaatttgtgtaaccatgatgttgttcttgggaatgaatccacttatgggacgccgcagacatgctaccctaataatgaaataggtatcctggacaaaacaataaaaaggaagattgcaccagtcaagaggggagaagacttgagcaagtccaggaggagcagaagtcctcctacatcggagctgatgatgaaattctttccttctttgaaaccaaaaccaaagtcagattcacacttgggaaatgaactcaagttaaacataagtcaagaccaaccacctggtgacaatgctcgatcccaggttttgagagagaaaattattgaattggaaacagaaatagaaaagtttaaagctgagaacgcatctttagctaaacttcgcattgaacgagaaagtgccttggaaaaactcaggaaagaaattgcagacttcgaacaacagaaagcaaaagaattagctcgaatagaagagtttaaaaaggaggagatgaggaagctacaaaaggaacgtaaagtttttgaaaagtatactacagctgcaagaacttttccagataaaaaggaacgtgaagaaatacaggactttaaaacagcaaatagcagatttacgggaagatttgaaaagaaaggagaccaaatggtcaagtacacacagccgtctcagaagccagatacaaatgttagtcagagagaacacagacctccgggaagaaataaaagtgatggaaagattccgactggatgcctggaagagagcagaagccatagagagcagcctcgaggtggagaagaaggacaagcttgcgaacacatctgttcgatttcaaaacagtcagatttcttcaggaacccaggtagaaaaatacaagaaaaattatcttccaatgcaaggcaatccacctcgaagatccaagtctgcacctcctcgtgatttaggcaatttggataagggacaagctgcctctcccagggagccacttgaaccactgaacttcccagatcctgaatataaagaggaggaggaagaccaagacatacagggagaaatcagtcatcctgatggaaaggtggaaaaggtttataagaatgggtgccgtgttatactgtttcccaatggaactcgaaaggaagtgagtgcagatgggaagaccatcactgtcactttctttaatggtgacgtgaagcaggtcatgccagaccaaagagtgatctactactatgcagctgcccagaccactcacacgacatacccggagggactggaagtcttacatttctcaagtggacaaatagaaaaacattacccagatggaagaaaagaaatcacgtttcctgaccagactgttaaaaacttatttcctgatggacaagaagaaagcattttcccagatggtacaattgtcagagtacaacgtgatggcaacaaactcatagagtttaataatggccaaagagaactacatactgcccagttcaagagacgggaatacccagatggcactgttaaaaccgtatatgcaaacggtcatcaagaaacgaagtacagatccggtcggataagagttaaggacaaggagggtaatgtgctaatggacacggagctgtgacgatcctcatgtgatcatgaagtaacagtaactgactttttatgttaaaaaatgtacatttactgtggattctgtttaatttattgtgtatgtgtggggaaaagattggattctaaaataaaagtttaccctgtggca

SEQ ID NO: 437458 - DNA, 1336 bp, Homo sapiens
  misc_feature (29)..(29): n is a, c, g, or t
  misc_feature (33)..(33): n is a, c, g, or t
cggcccgaggtcctgtgggaagtgagganctcnggacgggggcggggctccgacagaggcggcgattgtggcggcccatttgtaaatgctgcggagattgaggtgtcggttcgtgctgctgagctgcccaggcttcacggagcggtgttggaaatcaatagctcttctagcgactttaaaacagcaaatagcagatttacgggaagatttgaaaagaaaggagaccaaatggtcaagtacacacagccgtctcagaagccagatacaaatgttagtcagagagaacacagacctccgggaagaaataaaagtgatggaaagattccgactggatgcctggaagagagcagaagccatagagagcagcctcgaggtggagaagaaggacaagcttgcgaacacatctgttcgatttcaaaacagtcagatttcttcaggaacccaggtagaaaaatacaagaaaaattatcttccaatgcaaggcaatccacctcgaagatccaagtctgcacctcctcgtgatttaggcaatttggataagggacaagctgcctctcccagggagccacttgaaccactgaacttcccagatcctgaatataaagaggaggaggaagaccaagacatacagggagaaatcagtcatcctgatggaaaggtggaaaaggtttataagaatgggtgccgtgttatactgtttcccaatggaactcgaaaggaagtgagtgcagatgggaagaccatcactgtcactttctttaatggtgacgtgaagcaggtcatgccagaccaaagagtgatctactactatgcagctgcccagaccactcacacgacatacccggagggactggaagtcttacatttctcaagtggacaaatagaaaaacattacccagatggaagaaaagaaatcacgtttcctgaccagactgttaaaaacttatttcctgatggacaagaagaaagcattttcccagatggtacaattgtcagagtacaacgtgatggcaacaaactcatagagtttaataatggccaaagagaactacatactgcccagttcaagagacgggaatacccagatggcactgttaaaaccgtatatgcaaacggtcatcaagaaacgaagtacagatccggtcggataagagttaaggacaaggagggtaatgtgctaatggacacggagctgtgacgatcctcatgtgatcatgaagtaacagtaactgactttttatgttaaaaaatgtacatttactgtggattctgtttaatttattgtgtatgtgtggggaaaagattggattctaaaataaaagtttaccctgtggca

SEQ ID NO: 437459 - DNA, 2062 bp, Homo sapiens
cacctctcgttatcctgcccagttggtagatacttcgggggttcgtgctgctgagctgcccaggcttcacggagcggtgttggaaatcaatagctcttctagcctttgcattgtttaaatataatagtgtcattggactaagatgttcctgatgccaacctcttcagagttaaacagtgggcagaacttcctaacccagtggatgaccaatccttctcgggctggggtcatattaaatcgtggatttcctattatccccagagccttgtctgccatctgcccctttgctcaagcctaaacccctgtgtactcccagtactttttctgttatccttcaccatccactcccagtagtccctagactgatccctctgatgttattttctggatctattagttacattgaatcatatgaaattgctgatgtgtggcagtttgggacctataaatcagtgatttcccatggtgtaatggaaccattcctgtctcacaggcacagcacagccgcctcacacgcccagcagcttgttggctgaccacctgcctccgctctcctccttcaggccattctcccgtaacatccagctccgttacactttttaacatggaggtcagattctggcacttgctcgagacccttccaagttgagtgtttacaatatgatccattggcacataggatgaaaatactggcacttcagtgtatttttagagagagattcacctcactttgttgttggtgggggcgtgtttattttgtaatgtatatgttgctggtacagtatgtgattggtgtgctggacatattacaaaaagtttataccatagccacaagggcatttatgttttaactaaatacccagttatttggtgaagccaaattccacaggtcttagatgcctcttttatctgcaccttacaccttgtgattgtctctgaaatacatttgggtctgtcaggctgtttcatcacctgtctcttccccaggattgtaaactctgagacaagatactgtctttcttggacatctaggacttaagtacctgtgtcggagaactacaaattagtaaagaaaaatattaagacatccttaactaatggataaaggacagcagttcacaggatatgaactaaggaaatgtgtgatcatactaataaaattttcaattaaatattaaatctaactcttgacaattttattctaataggcaatccacctcgaagatccaagtctgcacctcctcgtgatttaggcaatttggataagggacaagctgcctctcccagggagccacttgaaccactgaacttcccagatcctgaatataaagaggaggaggaagaccaagacatacagggagaaatcagtcatcctgatggaaaggtggaaaaggtttataagaatgggtgccgtgttatactgtttcccaatggaactcgaaaggaagtgagtgcagatgggaagaccatcactgtcactttctttaatggtgacgtgaagcaggtcatgccagaccaaagagtgatctactactatgcagctgcccagaccactcacacgacatacccggagggactggaagtcttacatttctcaagtggacaaatagaaaaacattacccagatggaagaaaagaaatcacgtttcctgaccagactgttaaaaacttatttcctgatggacaagaagaaagcattttcccagatggtacaattgtcagagtacaacgtgatggcaacaaactcatagagtttaataatggccaaagagaactacatactgcccagttcaagagacgggaatacccagatggcactgttaaaaccgtatatgcaaacggtcatcaagaaacgaagtacagatccggtcggataagagttaaggacaaggagggtaatgtgctaatggacacggagctgtgacgatcctcatgtgatcatgaagtaacagtaactgactttttatgttaaaaaatgtacatttactgtggattctgtttaatttattgtgtatgtgtggggaaaagattggattctaaaataaaagtttaccctgtggca

SEQ ID NO: 437460 - DNA, 3122 bp, Homo sapiens
  misc_feature (29)..(29): n is a, c, g, or t
  misc_feature (33)..(33): n is a, c, g, or t
cggcccgaggtcctgtgggaagtgagganctcnggacgggggcggggctccgacagaggcggcgattgtggcggcccatttgtaaatgctgcggagattgaggtgtcggttcgtgctgctgagctgcccaggcttcacggagcggtgttggaaatcaatagctcttctagcctttgcattgtttaaatataatagtgtcattggactaagatgttcctgatgccaacctcttcagagttaaacagtgggcagaacttcctaacccagtggatgaccaatccttctcgggctggggtcatattaaatcgtggatttcctattttggaagcagacaaagagaagcgagcagctgtggacatttctaccagctttcctattaaaggcacacatttttctgatagcttcagctttataaatgaagaagattcacttcttgaagaacagaagttggagtcaaacaacccttacaaaccacagtcagataaatctgaaacccatacagcctttccttgcattaaaaagggaccacaggtagcggcatgtcacagtgctcctggacaccaggaagaaaacaaaaatgacttcatcccagatcttgcgagtgaattcaaagaaggggcttataaagacccactttttaaaaaacttgaacagctgaaagaagtacaacagaagaagcaggaacaattgaagaggcaacagttggagcaactacagagactcatggaagaacaagagaagctgctcaccatggtgtctgggcagtgcacacttccaggtttgagtttactgcctgatgatcagagccagaagcacaggtctccaggaaataccaccactggagagagagccacatgctgcttcccatcatatgtctacccggacccaacccaggaagaaacatacccgtccaacattttatcccatgagcaaagcaacttctgtagaactgctcatggagattttgtcttaacttcaaaacgtgcgtctcctaatttattttctgaggcacagtatcaagaagcacctgtggaaaaaaataatttaaaagaagaaaaccgtaaccatcctacaggagaaagtatcttatgttgggagaaagtgacagaacagattcaggaagcaaatgataagaacttacaaaaacatgatgattcctcagaagtggctaatattgaagaaaggcccattaaagctgctattggagaaaggaaacagacctttgaagattacttagaagaacaaattcagttggaagagcaagaactgaagcaaaaacagctgaaggaagcagaaggaccattgccaatcaaagcaaaaccaaaacaaccatttttaaaacgaggagaaggtttagctagatttactaatgccaaatctaagtttcaaaaaggcaaagaaagtaaactagtgactaaccagagcacttccgaggaccagccgctgtttaaaatggatagacagcaactccagcggaaaaccgctcttaaaaataaagagctgtgtgcagacaaccctatccttaaaaaggacagtaaagctagaaccaagagtggttctgtcaccctcagtcagaagccgaaaatgctgaagtgtagtaacaggaaaagtctttctccgtcaggattgaaaatacagacggggaagaaatgtgatgggcagtttagagaccagatcaaatttgaaaacaaagtcacatctaataataaagaaaatgtaactgagtgtccaaaaccttgcgatactggctgcacagggtggaataagacacaaggtaaagacagacttcctctttcaacagggccggccagccggctggctgctaagagccccataagggagaccatgaaagagtctgaatcttctcttgacgtttctcttcagaaaaagttagagacttgggaacgagaaaaggaaaaggaaaatttggaattagatgaatttttgtttttagaacaagctgctgatgaaatatcattttctagtaattcctcatttgtactgaaaatcttagaaagggatcaacagatctgcaaaggtcaccggatgtcttccacccctgtcaaagctgtgccacagaagacaaatccggcagatcccattagtcattgtaaccgcagtgaggatttggaccacactgcacgtgagaaggagagtgagtgtgaagtcgcacccaaacaacttcattcattgtcctcagctgatgaattgagggaacagccttgtaaaatcaggaaagccgtccaaaagagcacttctgaaaatcagactgaatggaatgcacgtgacgatgaaggtgttccaaatagtgacagtagcactgactctgaggaacagcttgatgttaccataaaaccatcgactgaggatagagagaggggcatcagcagcagagaggatagcccacaagtctgtgatgataaggggccttttaaggacaccaggacccaagaagataaaaggagagatgttgatctggatttgtctgataaagattacagtagcgatgagtctatcatggaaagcataaaacataaagtgtctgagccctcgagatcctcatccctaagtctgagtaaaatggactttgatgatgaaagaacttggactgaccttgaagagaatttgtgtaaccatgatgttgttcttgggaatgaatccacttatgggacgccgcagacatgctaccctaataatgaaataggtatcctggacaaaacaataaaaaggaagattgcaccagtcaagaggggagaagacttgagcaagtccaggaggagcagaagtcctcctacatcggagctgatgatgaaattctttccttctttgaaaccaaaaccaaagtcagattcacacttgggaaatgaactcaagttaaacataagtcaagaccaaccacctggtgagtcagagcattataaaatatgtatcagaatggtagaaatttaacattaatcagtatgctggcagaatgcttaaaatcctaactttccttaatgctcaatagaattaagtcaaattaattgggtggattttgaaaaatttgatttattttatgggtctttatgaggctttaaaaattaattaggttttaataaagtggagttaccatcaaagcttct

SEQ ID NO: 437461 - DNA, 468 bp, Homo sapiens
tcttcatttttatattctttgaaatgcaatgatagctctcatttataattcactaccctgtctttcaatagactaaggaaagcattttgactgtttagaaattgtgtacaggtttttacagtaagtgggtgtgtttattggttagaaatggctataaaaaaaaaccaagaagtacaggaagtacatcacctagatgtcccacagacacatcagccgtagagcactggacttgtacagaaggtgtactcaaggagtaaacacgtgtctctgtagccaaaatattactatgttcagttagtaccaaaattagaccatttgatcttctacagaggatcattaattattataacagaatgggaagttacaacagtggatgaatataaataggtcacacacaacaggtagtaatcatggtgaagagaaagcagttataacaaggctgactttgtaatgtaatgtctcaaaatg

SEQ ID NO: 437462 - DNA, 456 bp, Homo sapiens
gaatgggtgccgtgttatactgtttcccaatggaactcgaaaggaagtgagtgcagatgggaagaccatcactgtcactttctttaatggtgacgtgaagcaggtcatgccagaccaaagagtggtatgtttccagaggtgttctcctccatagtttaaccatctctggagaaaaggcagactgactgtgtgtctttacagatctactactatgcagctgcccagaccactcacacgacatacccggagggactggaagtcttacatttctcaagtggacaaataggtacaaacttgctccaccctctcattaaattcttcccttccttcaaaaaatatttactgtaacaactttttaaacagaaaaacattacccagatggaagaaaagaaatcacgtttcctgaccagactgttaaaaacttatttcctgatggacaagaagaaagcattttcc

SEQ ID NO: 437463 - DNA, 378 bp, Homo sapiens
aacgaggtgtccatgaagaattgtaaagttgatttaataaagttaattttgtatttaaaaagctgaaagaagtacaacagaagaagcaggaacaattgaagaggcaacagttggagcaactacagagactcatggaagaacaagagaagctgctcaccatggtgtctgggcagtgcacacttccaggtatgctttgcctacacagggcctcagtataatgcacatttcttacctgtagttgtttgacacgttatttctatcgttcctgtatcatgtgttgtgaactccagtttctttaaaggctagcccgataaatgtgaaatggtagagttgtaatacaactggaacaagaaggagctgccgcattctggtgtgcgc

SEQ ID NO: 437464 - DNA, 710 bp, Homo sapiens
tggacccccctttgaggtgggaaggacaccaggacccaagaagataaaaggagagatgttgatctggatttgtctgataaagattacagtagcgatgagtctatcatggaaagcataaaacataaagtgtctgagccctcgagatcctcatccctaagtctgagtaaaatggactttgatgatgaaagaacttggactgaccttgaagagaatttgtgtaaccatgatgttgttcttgggaatgaatccacttatgggacgccgcagacatgctaccctaataatgaaataggtatcctggacaaaacaataaaaaggaagattgcaccagtcaagaggggagaagacttgagcaagtccaggaggagcagaagtcctcctacatcggagctgatgatgaaattctttccttctttgaaaccaaaaccaaagtcagattcacacttgggaaatgaactcaagttaaacataagtcaagaccaaccacctggtgagtcagagcattataaaatatgtatcagaatggtagaaatttaacattaatcagtatgctggcagaatgcttaaaatcctaactttccttaatgctcaatagaattaagtcaaattaattgggtggattttgaaaaatttgatttattttatgggtctttatgaggctttaaaaattaattaggttttaataaagtggagttaccatcaaagcttct

SEQ ID NO: 437465 - DNA, 4517 bp, Homo sapiens
  misc_feature (29)..(29): n is a, c, g, or t
  misc_feature (33)..(33): n is a, c, g, or t
cggcccgaggtcctgtgggaagtgagganctcnggacgggggcggggctccgacagaggcggcgattgtggcggcccatttgtaaatgctgcggagattgaggtgtcggttcgtgctgctgagctgcccaggcttcacggagcggtgttggaaatcaatagctcttctagcctttgcattgtttaaatataatagtgtcattggactaagatgttcctgatgccaacctcttcagagttaaacagtgggcagaacttcctaacccagtggatgaccaatccttctcgggctggggtcatattaaatcgtggatttcctattttggaagcagacaaagagaagcgagcagctgtggacatttctaccagctttcctattaaaggcacacatttttctgatagcttcagctttataaatgaagaagattcacttcttgaagaacagaagttggagtcaaacaacccttacaaaccacagtcagataaatctgaaacccatacagcctttccttgcattaaaaagggaccacaggtagcggcatgtcacagtgctcctggacaccaggaagaaaacaaaaatgacttcatcccagatcttgcgagtgaattcaaagaaggggcttataaagacccactttttaaaaaacttgaacagctgaaagaagtacaacagaagaagcaggaacaattgaagaggcaacagttggagcaactacagagactcatggaagaacaagagaagctgctcaccatggtgtctgggcagtgcacacttccaggtttgagtttactgcctgatgatcagagccagaagcacaggtctccaggaaataccaccactggagagagagccacatgctgcttcccatcatatgtctacccggacccaacccaggaagaaacatacccgtccaacattttatcccatgagcaaagcaacttctgtagaactgctcatggagattttgtcttaacttcaaaacgtgcgtctcctaatttattttctgaggcacagtatcaagaagcacctgtggaaaaaaataatttaaaagaagaaaaccgtaaccatcctacaggagaaagtatcttatgttgggagaaagtgacagaacagattcaggaagcaaatgataagaacttacaaaaacatgatgattcctcagaagtggctaatattgaagaaaggcccattaaagctgctattggagaaaggaaacagacctttgaagattacttagaagaacaaattcagttggaagagcaagaactgaagcaaaaacagctgaaggaagcagaaggaccattgccaatcaaagcaaaaccaaaacaaccatttttaaaacgaggagaaggtttagctagatttactaatgccaaatctaagtttcaaaaaggcaaagaaagtaaactagtgactaaccagagcacttccgaggaccagccgctgtttaaaatggatagacagcaactccagcggaaaaccgctcttaaaaataaagagctgtgtgcagacaaccctatccttaaaaaggacagtaaagctagaaccaagagtggttctgtcaccctcagtcagaagccgaaaatgctgaagtgtagtaacaggaaaagtctttctccgtcaggattgaaaatacagacggggaagaaatgtgatgggcagtttagagaccagatcaaatttgaaaacaaagtcacatctaataataaagaaaatgtaactgagtgtccaaaaccttgcgatactggctgcacagggtggaataagacacaaggtaaagacagacttcctctttcaacagggccggccagccggctggctgctaagagccccataagggagaccatgaaagagtctgaatcttctcttgacgtttctcttcagaaaaagttagagacttgggaacgagaaaaggaaaaggaaaatttggaattagatgaatttttgtttttagaacaagctgctgatgaaatatcattttctagtaattcctcatttgtactgaaaatcttagaaagggatcaacagatctgcaaaggtcaccggatgtcttccacccctgtcaaagctgtgccacagaagacaaatccggcagatcccattagtcattgtaaccgcagtgaggatttggaccacactgcacgtgagaaggagagtgagtgtgaagtcgcacccaaacaacttcattcattgtcctcagctgatgaattgagggaacagccttgtaaaatcaggaaagccgtccaaaagagcacttctgaaaatcagactgaatggaatgcacgtgacgatgaaggtgttccaaatagtgacagtagcactgactctgaggaacagcttgatgttaccataaaaccatcgactgaggatagagagaggggcatcagcagcagagaggatagcccacaagtctgtgatgataaggggccttttaaggacaccaggacccaagaagataaaaggagagatgttgatctggatttgtctgataaagattacagtagcgatgagtctatcatggaaagcataaaacataaagtgtctgagccctcgagatcctcatccctaagtctgagtaaaatggactttgatgatgaaagaacttggactgaccttgaagagaatttgtgtaaccatgatgttgttcttgggaatgaatccacttatgggacgccgcagacatgctaccctaataatgaaataggtatcctggacaaaacaataaaaaggaagattgcaccagtcaagaggggagaagacttgagcaagtccaggaggagcagaagtcctcctacatcggagctgatgatgaaattctttccttctttgaaaccaaaaccaaagtcagattcacacttgggaaatgaactcaagttaaacataagtcaagaccaaccacctggtgacaatgctcgatcccaggttttgagagagaaaattattgaattggaaacagaaatagaaaagtttaaagctgagaacgcatctttagctaaacttcgcattgaacgagaaagtgccttggaaaaactcaggaaagaaattgcagacttcgaacaacagaaagcaaaagaattagctcgaatagaagagtttaaaaaggaggagatgaggaagctacaaaaggaacgtaaagtttttgaaaagtatactacagctgcaagaacttttccagataaaaaggaacgtgaagaaatacaggactttaaaacagcaaatagcagatttacgggaagatttgaaaagaaaggagaccaaatggtcaagtacacacagccgtctcagaagccagatacaaatgttagtcagagagaacacagacctccgggaagaaataaaagtgatggaaagattccgactggatgcctggaagagagcagaagccatagagagcagcctcgaggtggagaagaaggacaagcttgcgaacacatctgttcgatttcaaaacagtcagatttcttcaggaacccaggtagaaaaatacaagaaaaattatcttccaatgcaaggcacagcacagccgcctcacacgcccagcagcttgttggctgaccacctgcctccgctctcctccttcaggccattctcccgtaacatccagctccgttacactttttaacatggaggtcagattctggcacttgctcgagacccttccaagcaatccacctcgaagatccaagtctgcacctcctcgtgatttaggcaatttggataagggacaagctgcctctcccagggagccacttgaaccactgaacttcccagatcctgaatataaagaggaggaggaagaccaagacatacagggagaaatcagtcatcctgatggaaaggtggaaaaggtttataagaatgggtgccgtgttatactgtttcccaatggaactcgaaaggaagtgagtgcagatgggaagaccatcactgtcactttctttaatggtgacgtgaagcaggtcatgccagaccaaagagtgatctactactatgcagctgcccagaccactcacacgacatacccggagggactggaagtcttacatttctcaagtggacaaatagaaaaacattacccagatggaagaaaagaaatcacgtttcctgaccagactgttaaaaacttatttcctgatggacaagaagaaagcattttcccagatggtacaattgtcagagtacaacgtgatggcaacaaactcatagagtttaataatggccaaagagaactacatactgcccagttcaagagacgggaatacccagatggcactgttaaaaccgtatatgcaaacggtcatcaagaaacgaagtacagatccggtcggataagagttaaggacaaggagggtaatgtgctaatggacacggagctgtgacgatcctcatgtgatcatgaagtaacagtaactgactttttatgttaaaaaatgtacatttactgtggattctgtttaatttattgtgtatgtgtggggaaaagattggattctaaaataaaagtttaccctgtggca

SEQ ID NO: 437466 - DNA, 3620 bp, Homo sapiens
  misc_feature (29)..(29): n is a, c, g, or t
  misc_feature (33)..(33): n is a, c, g, or t
cggcccgaggtcctgtgggaagtgagganctcnggacgggggcggggctccgacagaggcggcgattgtggcggcccatttgtaaatgctgcggagattgaggtgtcggttcgtgctgctgagctgcccaggcttcacggagcggtgttggaaatcaatagctcttctagcctttgcattgtttaaatataatagtgtcattggactaagatgttcctgatgccaacctcttcagagttaaacagtgggcagaacttcctaacccagtggatgaccaatccttctcgggctggggtcatattaaatcgtggatttcctattttggaagcagacaaagagaagcgagcagctgtggacatttctaccagctttcctattaaaggcacacatttttctgatagcttcagctttataaatgaagaagattcacttcttgaagaacagaagttggagtcaaacaacccttacaaaccacagtcagataaatctgaaacccatacagcctttccttgcattaaaaagggaccacaggtagcggcatgtcacagtgctcctggacaccaggaagaaaacaaaaatgacttcatcccagatcttgcgagtgaattcaaagaaggggcttataaagacccactttttaaaaaacttgaacagctgaaagaagtacaacagaagaagcaggaacaattgaagaggcaacagttggagcaactacagagactcatggaagaacaagagaagctgctcaccatggtgtctgggcagtgcacacttccaggtttgagtttactgcctgatgatcagagccagaagcacaggtctccaggaaataccaccactggagagagagccacatgctgcttcccatcatatgtctacccggacccaacccaggaagaaacatacccgtccaacattttatcccatgagcaaagcaacttctgtagaactgctcatggagattttgtcttaacttcaaaacgtgcgtctcctaatttattttctgaggcacagtatcaagaagcacctgtggaaaaaaataatttaaaagaagaaaaccgtaaccatcctacaggagaaagtatcttatgttgggagaaagtgacagaacagattcaggaagcaaatgataagaacttacaaaaacatgatgattcctcagaagtggctaatattgaagaaaggcccattaaagctgctattggagaaaggaaacagacctttgaagattacttagaagaacaaattcagttggaagagcaagaactgaagcaaaaacagctgaaggaagcagaaggaccattgccaatcaaagcaaaaccaaaacaaccatttttaaaacgaggagaaggtttagctagatttactaatgccaaatctaagtttcaaaaaggcaaagaaagtaaactagtgactaaccagagcacttccgaggaccagccgctgtttaaaatggatagacagcaactccagcggaaaaccgctcttaaaaataaagagctgtgtgcagacaaccctatccttaaaaaggacagtaaagctagaaccaagagtggttctgtcaccctcagtcagaagccgaaaatgctgaagtgtagtaacaggaaaagtctttctccgtcaggattgaaaatacagacggggaagaaatgtgatgggcagtttagagaccagatcaaatttgaaaacaaagtcacatctaataataaagaaaatgtaactgagtgtccaaaaccttgcgatactggctgcacagggtggaataagacacaaggtaaagacagacttcctctttcaacagggccggccagccggctggctgctaagagccccataagggagaccatgaaagagtctgaatcttctcttgacgtttctcttcagaaaaagttagagacttgggaacgagaaaaggaaaaggaaaatttggaattagatgaatttttgtttttagaacaagctgctgatgaaatatcattttctagtaattcctcatttgtactgaaaatcttagaaagggatcaacagatctgcaaaggtcaccggatgtcttccacccctgtcaaagctgtgccacagaagacaaatccggcagatcccattagtcattgtaaccgcagtgaggatttggaccacactgcacgtgagaaggagagtgagtgtgaagtcgcacccaaacaacttcattcattgtcctcagctgatgaattgagggaacagccttgtaaaatcaggaaagccgtccaaaagagcacttctgaaaatcagactgaatggaatgcacgtgacgatgaaggtgttccaaatagtgacagtagcactgactctgaggaacagcttgatgttaccataaaaccatcgactgaggatagagagaggggcatcagcagcagagaggatagcccacaagtctgtgatgataaggggccttttaaggacaccaggacccaagaagataaaaggagagatgttgatctggatttgtctgataaagattacagtagcgatgagtctatcatggaaagcataaaacataaagtgtctgagccctcgagatcctcatccctaagtctgagtaaaatggactttgatgatgaaagaacttggactgaccttgaagagaatttgtgtaaccatgatgttgttcttgggaatgaatccacttatgggacgccgcagacatgctaccctaataatgaaataggtatcctggacaaaacaataaaaaggaagattgcaccagtcaagaggggagaagacttgagcaagtccaggaggagcagaagtcctcctacatcggagctgatgatgaaattctttccttctttgaaaccaaaaccaaagtcagattcacacttgggaaatgaactcaagttaaacataagtcaagaccaaccacctggtgacaatgctcgatcccaggttttgagagagaaaattattgaattggaaacagaaatagaaaagtttaaagctgagaacgcatctttagctaaacttcgcattgaacgagaaagtgccttggaaaaactcaggaaagaaattgcagacttcgaacaacagaaagcaaaagaattagctcgaatagaagagtttaaaaaggaggagatgaggaagctacaaaaggaacgtaaagtttttgaaaagtatactacagctgcaagaacttttccagataaaaaggaacgtgaagaaatacaggactttaaaacagcaaatagcagatttacgggaagatttgaaaagaaaggagaccaaatggtcaagtacacacagccgtctcagaagccagatacaaatgttagtcagagagaacacagacctccgggaagaaataaaagtgatggaaagattccgactggatgcctggaagagagcagaagccatagagagcagcctcgaggtggagaagaaggacaagcttgcgaacacatctgttcgatttcaaaacagtcagatttcttcaggaacccaggtagaaaaatacaagaaaaattatcttccaatgcaaggtaagaggctgcatgatctttttataaaacatttcagaatgtaaggaataaacaatttatacccaacttaataaaacatttcttaataaatgtttttgaacatttgaa

SEQ ID NO: 437467 - DNA, 955 bp, Homo sapiens
gcaaattcttacaccttctctccaagcggagggcacactgtggtcaaaatcacttattttattaggaaaaagaggtaactgttccaaagtgtagtgtcctttgttgaaggaggagggatgtaagcatagatttgttcttgtttctggctattctcagctcaagccatgtttaattcattctttgtaaaagccttcaattgtgccacagaaaacctggtaagagaattgtcagtttcattggccataagtatgtaatgtgggtgatgtcttgccattgaggtttggaagctcttaagtgccgattatggattacagagggctgataaaattacttatattgggaattgagagaagccccaaaaaatcaaatgtgcttttgatggatagagtgtatcttattagcattatgggagctccttagagggctgtcttcactgaaagatttaatgcccaaaacatttggacagattatgcagccttctactaccaggttatcttgaatgaagaagaaatagtaaaaaataataataatagagcattaccaataagctaaaagttcagagttgctgatagatgttaaatgttaagttatcctgtgagcctactcctgtccaaccttttttctcagtatttctttagagaatgctgcaatctgtataagttactctgaaggattttttaagaagagaagccaccaacaggtgataatttttatggagatgtttcttaattggctttccctcagttcaagtaggtaaataactttgtttgctgggaggaggtacatggctgaagagaggcaaatagattaagatagcaatgtcttgcacttcctgtttccctcaaaacaacaccacattgtggggccgcaggatagatcagggttgagtggaatttggaattccaggtgaagtgcttgtaaagtgcatgtctagctgacaacagacttgaccat

SEQ ID NO: 437468 - DNA, 2061 bp, Homo sapiens
aaattttttaaataaatagactggtagagaacactgatcagtatcccctaataaatccactttatcctcggatggtttctatcatgtaaacataggattaaactcttagcacaaataaaatggaatgttttcgtctctacattcagctcttctcacagacagttttatcatcttatcatttttggcacaaaacaaactatgttttattcagtttaccaagaagatggagtcttctgatgtaaacaaaagactggaaaaactctcagccttggattataagattttctattatgaaatacccggcccaataaacaagacaacagagcgacatctagctatcaactgtgttcatgatagagttgtttgctggtggccactggtcaacgatgatgcttggccttgggcccccatttcttctgagaaggacagagccaatctactcctcctgggttatgctcaaggaagactagaggttctgagttctgtccgcacagaatgggacccactggatgttcgctttggcaccaaacagccttatcaggtgttcacagtggagcactccgtaagtgtagacaaagagcccatggctgacagctgcatctatgaatgcattcggaataaaatccagtgtgtgtcagtcaccagaataccactaaagtcaaaggccatcagctgctgcaggaatgttactgaagacaaactgattctgggctgtgaagattcttcgctaattctttatgaaactcaccgtagagtgactctcttagcacagactgaacttttgccttcattaataagctgccacccaagtggtgccattctgctagttggcagcaaccaaggggagttgcaaatttttgatatggctctatcccctattaacatccaactgttggctgaagaccgcttacccagggagactctgcaattcagtaaattatttgatgcctccagcagtcttgttcaaatgcaatggatagctcctcaggttgtttctcagaagggtgaaggtagtgatatctatgatctcctcttcctcaggtttgaaagaggacctttgggtgtgctgttgtttaaactaggcgtcttcactcgaggacagctgggcctgatagacatcatcttccagtacattcactgtgatgagatctatgaggcaataaacatcctgagcagcatgaactgggacactctgggccaccagtgctttatcagcatgagcgccattgtaaaccatcttcttagacagaagctcactccagagagagaagcacagcttgagacaagccttggaaccttctatgctccaacaagaccacttctggattccactatattggaatatagagatcaaatcagcaaatatgcaaggagattcttccatcacttgctcaggtaccagaggtttgaaaaggcatttctcctagctgttgacgttggtgctcgtgacctctttatggatattcattaccttgcactagataaaggtgaattggcactagctgaagtggcaagaaaaagagctagtgacattgatgcagaatcaataacctctggggttgaactcctgggacccttggacagaggggatatgctaaatgaagcatttattggcctgtctttagcacctcaaggagaagactcatttccagataacctccctccctcttgcccaacccacagacatattttacaacaaagaatactgaatggctcttctaacagacaaataattgacagaaggaatgaacttgaaaaagacatctgttctggatttttgatgactaatacctgtaatgcagaagacggagaactgagagaagacggcagagaacaggaaatcagagatggtggttctctcaaaatgattcactttggtctggtgtaaacattaagaaaaaaagaaaactgccttcttcatatctaaacttttcatggcctgatacagacttaaaatcccccgtgtggatttttaacaagagacagtatgaatcatataaattagttaagagttttgagttgagtgtttgttttcaaaataaagttttattatttcaaaaa

SEQ ID NO: 437469 - DNA, 286 bp, Homo sapiens
atgccaacactaccgcgatacataaccatcaccgactacagatctccactcacacctttagggaaatcagagatggtggttctctcaaaatgattcactttggtctggtgtaaacattaagaaaaaaagaaaactgccttcttcatatctaaacttttcatggcctgatacagacttaaaatcccccgtgtggatttttaacaagagacagtatgaatcatataaattagttaagagttttgagttgagtgtttgttttcaaaataaagttttattatttcaaaaa

SEQ ID NO: 437470 - DNA, 755 bp, Homo sapiens
acactctggaggggcgggggaattgataagttgggacgaccggacagcttctcaggttgctaagcgacgaggcgggagcgcacgcacaccctggctgctttgtagcacctgaggaaactgtggcggcggcggcggcgtcctggagacccaagagaccaagcgagcgtgtcgctccctctcgggtccgaggacctagcctaggaaccttctgcccggggtagtgtctggtgatgaggcgagagttttgctgggacgcctactccaaagcggccgggagtcgcgcttcttccccactcccgagacagttgattgaagatcagcaaacattgaaaaaaagttaattgtgctatctggttagccgaactcaaactcacgatgacagaaacaagaaaactcacttcctgtcgtaagaaggaggttccccacagacattgaattaacaactggatgaaaacttcaaggaaactgggtccatagttcacaacaagcctagatctgggagatgccagcaagcagaaaaactgtggctgaaattgaggcagtgttagcagagtcccaaaagcatgcactgcacatttgctgaattgaatattccaaaaccacaggttacagaattctaacagtgaaattccgaagcatacctaaatgtataaatgctacaagttaaccaggctgaacttggcttctgtcatctaatgaaatgagaaaatgaaatttccaaaaatattcttgacaagttgacccttataatgaag

SEQ ID NO: 437471 - DNA, 2975 bp, Homo sapiens
acactctggaggggcgggggaattgataagttgggacgaccggacagcttctcaggttgctaagcgacgaggcgggagcgcacgcacaccctggctgctttgtagcacctgaggaaactgtggcggcggcggcggcgtcctggagacccaagagaccaagcgagcgtgtcgctccctctcgggtccgaggacctagcctaggaaccttctgcccggggtagtgtctggtgatgaggcgagagttttgctgggacgcctactccaaagcggccgggagtcgcgcttcttccccactcccgagacaggatagagattccttctgccatcagatgtctttctgcttgactgaactgcacctgtggtctttgaagaataccttacacattgcggatagagacattgggatctaccagtattatgacaagaaagatccaccagcgacagagcatggtaacttagaaaagaagcagaagctggcagagtcacgagattatccttggacgctcaaaaacagacgcccagaaaaactccgagactcgctcaaagagttggaggagctgatgcaaaacagtcggtgtgtgctgagcaaatggaagaacaaatatgtctgtcagctcctttggttcaggtgtgctggtgtctctaagcctttctgggccgcagctggagaaagtggtgattgacagaagcctggtggggaagctcatctcagacaccatcagtgatgctcttctcacagacagttttatcatcttatcatttttggcacaaaacaaactatgttttattcagtttaccaagaagatggagtcttctgatgtaaacaaaagactggaaaaactctcagccttggattataagattttctattatgaaatacccggcccaataaacaagacaacagagcgacatctagctatcaactgtgttcatgatagagttgtttgctggtggccactggtcaacgatgatgcttggccttgggcccccatttcttctgagaaggacagagccaatctactcctcctgggttatgctcaaggaagactagaggttctgagttctgtccgcacagaatgggacccactggatgttcgctttggcaccaaacagccttatcaggtgttcacagtggagcactccgtaagtgtagacaaagagcccatggctgacagctgcatctatgaatgcattcggaataaaatccagtgtgtgtcagtcaccagaataccactaaagtcaaaggccatcagctgctgcaggaatgttactgaagacaaactgattctgggctgtgaagattcttcgctaattctttatgaaactcaccgtagagtgactctcttagcacagactgaacttttgccttcattaataagctgccacccaagtggtgccattctgctagttggcagcaaccaaggggagttgcaaatttttgatatggctctatcccctattaacatccaactgttggctgaagaccgcttacccagggagactctgcaattcagtaaattatttgatgcctccagcagtcttgttcaaatgcaatggatagctcctcaggttgtttctcagaagggtgaaggtagtgatatctatgatctcctcttcctcaggtttgaaagaggacctttgggtgtgctgttgtttaaactaggcgtcttcactcgaggacagctgggcctgatagacatcatcttccagtacattcactgtgatgagatctatgaggcaataaacatcctgagcagcatgaactgggacactctgggccaccagtgctttatcagcatgagcgccattgtaaaccatcttcttagacagaagctcactccagagagagaagcacagcttgagacaagccttggaaccttctatgctccaacaagaccacttctggattccactatattggaatatagagatcaaatcagcaaatatgcaaggagattcttccatcacttgctcaggtaccagaggtttgaaaaggcatttctcctagctgttgacgttggtgctcgtgacctctttatgaactcctgggacccttggacagaggggatatgctaaatgaagcatttattggcctgtctttagcacctcaaggagaagactcatttccagataacctccctccctcttgcccaacccacagacatattttacaacaaagaatactgaatggctcttctaacagacaaataattgacagaaggaatgaacttgaaaaagacatctgttctggatttttgatgactaatacctgtaatgcagaagacggagaactgagagaagacggcagagaacaggaaatcagagatggtggttctctcaaaatgattcactttggtctggtgtaaacattaagaaaaaaagaaaactgccttcttcatatctaaacttttcatggcctgatacagacttaaaatcccccgtgtggatttttaacaagagacagtatgaatcatataaattagttaagagttttgagttgagtgtttgttttcaaaataaagttttattatttcaaaaacatgcagcataacagcaaagtgatcgtaagtaaaagtcttcaacctacttattttcaataatgtaaaattttgaaagtgtcttaaattgtatgttaattaggtgctacaaaaatagaatatttaaactttgttctcccaggtactttaaaaaaggggcagtagggggcaggcatagtgctcatgcctgtagtcccagtgctttaggaggccaaggctgaaggatcacttgagcccaggagttcaagactagcctgtgcaacatagtgaaacgctgtctctagaaaaaattttaaaaattagccaggcatggtggtacatgcttgtgaagctgaggcagaagaattgcttgagcccaggagttcaaggctacagtgagctgtgatcgcgccactgcactctaacctgggcaacagagagtgaccctgtctccaaaaa

SEQ ID NO: 437472 - DNA, 2835 bp, Homo sapiens
acactctggaggggcgggggaattgataagttgggacgaccggacagcttctcaggttgctaagcgacgaggcgggagcgcacgcacaccctggctgctttgtagcacctgaggaaactgtggcggcggcggcggcgtcctggagacccaagagaccaagcgagcgtgtcgctccctctcgggtccgaggacctagcctaggaaccttctgcccggggtagtgtctggtgatgaggcgagagttttgctgggacgcctactccaaagcggccgggagtcgcgcttcttccccactcccgagacaggatagagattccttctgccatcagatgtctttctgcttgactgaactgcacctgtggtctttgaagaataccttacacattgcggatagagacattgggatctaccagtattatgacaagaaagatccaccagcgacagagcatggtaacttagaaaagaagcagaagctggcagagtcacgagattatccttggacgctcaaaaacagacgcccagaaaaactccgagactcgctcaaagagttggaggagctgatgcaaaacagtcggtgtgtgctgagcaaatggaagaacaaatatgtctgtcagctcctttggttcaggtgtgctggtgtctctaagcctttctgggccgcagctggagaaagtggtgattgacagaagcctggtggggaagctcatctcagacaccatcagtgatgctcttctcacagacagttttatcatcttatcatttttggcacaaaacaaactatgttttattcagtttaccaagaagatggagtcttctgatgtaaacaaaagactggaaaaactctcagccttggattataagattttctattatgaaatacccggcccaataaacaagacaacagagcgacatctagctatcaactgtgttcatgatagagttgtttgctggtggccactggtcaacgatgatgcttggccttgggcccccatttcttctgagaaggacagagccaatctactcctcctgggttatgctcaaggaagactagaggttctgagttctgtccgcacagaatgggacccactggatgttcgctttggcaccaaacagccttatcaggtgttcacagtggagcactccgtaagtgtagacaaagagcccatggctgacagctgcatctatgaatgcattcggaataaaatccagtgtgtgtcagtcaccagaataccactaaagtcaaaggccatcagctgctgcaggaatgttactgaagacaaactgattctgggctgtgaagattcttcgctaattctttatgaaactcaccgtagagtgactctcttagcacagactgaacttttgccttcattaataagctgccacccaagtggtgccattctgctagttggcagcaaccaaggggagttgcaaatttttgatatggctctatcccctattaacatccaactgttggctgaagaccgcttacccagggagactctgcaattcagtaaattatttgatgcctccagcagtcttgttcaaatgcaatggatagctcctcaggttgtttctcagaagggtgaaggtagtgatatctatgatctcctcttcctcaggtttgaaagaggacctttgggtgtgctgttgtttaaactaggcgtcttcactcgaggacagctgggcctgatagacatcatcttccagtacattcactgtgatgagatctatgaggcaataaacatcctgagcagcatgaactgggacactctgggccaccagtgctttatcagcatgagcgccattgtaaaccatcttcttagacagaagctcactccagagagagaagcacagcttgagacaagccttggaaccttctatgctccaacaagaccacttctggattccactatattggaatatagagatcaaatcagcaaatatgcaaggagattcttccatcacttgctcagaaactcctgttaaagtagtagtatcatttgacaaattggacaaagaatataatagagaagtcaagcatgacttcaagtgttttgacctgagcaattggaaaaacaaaattgttactgacaagattgataagactccagaaagaacaggtaccagaggtttgaaaaggcatttctcctagctgttgacgttggtgctcgtgacctctttatggatattcattaccttgcactagataaaggtgaattggcactagctgaagtggcaagaaaaagagctagtgacattgatgcagaatcaataacctctggggttgagtttgttgaaatggaagagcactggctttgtgccagacatttcagaactcctgggacccttggacagaggggatatgctaaatgaagcatttattggcctgtctttagcacctcaaggagaagactcatttccagataacctccctccctcttgcccaacccacagacatattttacaacaaagaatactgaatggctcttctaacagacaaataattgacagaaggaatgaacttgaaaaagacatctgttctggatttttgatgactaatacctgtaatgcagaagacggagaactgagagaagacggcagagaacaggaaatcagagatggtggttctctcaaaatgattcactttggtctggtgtaaacattaagaaaaaaagaaaactgccttcttcatatctaaacttttcatggcctgatacagacttaaaatcccccgtgtggatttttaacaagagacagtatgaatcatataaattagttaagagttttgagttgagtgtttgttttcaaaataaagttttattatttcaaaaa

SEQ ID NO: 437473 - DNA, 2213 bp, Homo sapiens
acactctggaggggcgggggaattgataagttgggacgaccggacagcttctcaggttgctaagcgacgaggcgggagcgcacgcacaccctggctgctttgtagcacctgaggaaactgtggcggcggcggcggcgtcctggagacccaagagaccaagcgagcgtgtcgctccctctcgggtccgaggacctagcctaggaaccttctgcccggggtagtgtctggtgatgaggcgagagttttgctgggacgcctactccaaagcggccgggagtcgcgcttcttccccactcccgagacaggatagagattccttctgccatcagatgtctttctgcttgactgaactgcacctgtggtctttgaagaataccttacacattgcggatagagacattgggatctaccagtattatgacaagaaagatccaccagcgacagagcatggtaacttagaaaagaagcagaagctggcagagtcacgagattatccttggacgctcaaaaacagacgcccagaaaaactccgagactcgctcaaagagttggaggagctgatgcaaaacagtcggtgtgtgctgagcaaatggaagaacaaatatgtctgtcagctcctttggttcaggtgtgctggtgtctctaagcctttctgggccgcagctggagaaagtggtgattgacagaagcctggtggggaagctcatctcagacaccatcagtgatgctcttctcacagacagttttatcatcttatcatttttggcacaaaacaaactatgttttattcagtttaccaagaagatggagtcttctgatgtaaacaaaagactggaaaaactctcagccttggattataagattttctattatgaaatacccggcccaataaacaagacaacagagcgacatctagctatcaactgtgttcatgatagagttgtttgctggtggccactggtcaacgatgatgcttggccttgggcccccatttcttctgagaaggacagagccaatctactcctcctgggttatgctcaaggaagactagaggttctgagttctgtccgcacagaatgggacccactggatgttcgctttggcaccaaacagccttatcaggtgttcacagtggagcactccgtaagtgtagacaaagagcccatggctgacagctgcatctatgaatgcattcggaataaaatccagtgtgtgtcagtcaccagaataccactaaagtcaaaggccatcagctgctgcaggaatgttactgaagacaaactgattctgggctgtgaagattcttcgctaattctttatgaaactcaccgtagagtgactctcttagcacagactgaacttttgccttcattaataagctgccacccaagtggtgccattctgctagttggcagcaaccaaggggagttgcaaatttttgatatggctctatcccctattaacatccaactgttggctgaagaccgcttacccagggagactctgcaattcagtaaattatttgatgcctccagcagtcttgttcaaatgcaatggatagctcctcaggttgtttctcagaagggtgaaggtagtgatatctatgatctcctcttcctcaggtttgaaagaggacctttgggtgtgctgttgtttaaactaggcgtcttcactcgaggacagctgggcctgatagacatcatcttccagtacattcactgtgatgagatctatgaggcaataaacatcctgagcagcatgaactgggacactctgggccaccagtgctttatcagcatgagcgccattgtaaaccatcttcttagacagaagctcactccagagagagaagcacagcttgagacaagccttggaaccttctatgctccaacaagaccacttctggattccactatattggaatatagagatcaaatcagcaaatatgcaaggagattcttccatcacttgctcaggtaccagaggtttgaaaaggcatttctcctagctgttgacgttggtgctcgtgacctctttatggttcttggacacatgtgcggaacatgcaggtttgtcacataggtacctcagttggaaatgcagaaatcacccaccttctgtgttgatctcactgggagctgcagactggagctgttccaattcagccatcttgccagccacccatatgtcacattttctttatacaatcaacc

SEQ ID NO: 437474 - DNA, 428 bp, Homo sapiens
cagttggatctttgtgtggcatgttgatctttttttgcttgcaaatcagaggcactttaactgataatgacaatgtgtacagccaactacgctctctctttttctgttgtgcttcaggagctgatgcaaaacagtcggtgtgtgctgagcaaatggaagaacaaatatgtctgtcaggtaaaatgatttgacaagcctttgcagtgtttaaccaatggagctgaaaactatgtagtaattggtattcttgtgttatgttaggtaatggacaaaaacttttttagcagtggttatttcatagtttgaattctagttgttctagagctaacattagacagattgacacaggccaccaggctcattaatcagtattaaccagtatagttgtactgacatacaaacactaataaaaatcttttcatattgta

SEQ ID NO: 437475 - DNA, 437 bp, Homo sapiens
tgtgaagttgaagaaaaaccaaagtttatctgaatgtacttgatatatttcttaacaggttctgagttctgtccgcacagaatgggacccactggatgttcgctttggcaccaaacagccttatcaggtgttcacagtggagcactccgtaagtgtagacaaagagcccatggctgacagctgcatctatgaatgcattcggaataaaatccagtgtgtgtcagtcaccagaataccactaaagtcaaaggccatcagctgctgcaggaatgttactgaagacaaactgattctgggctgtgaagattcttcgctaattctttatgaaactcaccgtagagtgactctcttagcacagactgaacttttgccttcattaataagctgccacccaagtggtgccattctgctagttggcagcaaccaaggggagttgc

SEQ ID NO: 437476 - DNA, 2471 bp, Homo sapiens
atctctgcaagacaaaagtcagaaatggcttccctggggactgagagcccatagttctcttcccactgctgcttctacccttttgttttgcttggctctctaaaattgtctcagctccagctcttctcacagacagttttatcatcttatcatttttggcacaaaacaaactatgttttattcagtttaccaagaagatggagtcttctgatgtaaacaaaagactggaaaaactctcagccttggattataagattttctattatgaaatacccggcccaataaacaagacaacagagcgacatctagctatcaactgtgttcatgatagagttgtttgctggtggccactggtcaacgatgatgcttggccttgggcccccatttcttctgagaaggacagagccaatctactcctcctgggttatgctcaaggaagactagaggttctgagttctgtccgcacagaatgggacccactggatgttcgctttggcaccaaacagccttatcaggtgttcacagtggagcactccgtaagtgtagacaaagagcccatggctgacagctgcatctatgaatgcattcggaataaaatccagtgtgtgtcagtcaccagaataccactaaagtcaaaggccatcagctgctgcaggaatgttactgaagacaaactgattctgggctgtgaagattcttcgctaattctttatgaaactcaccgtagagtgactctcttagcacagactgaacttttgccttcattaataagctgccacccaagtggtgccattctgctagttggcagcaaccaaggggagttgcaaatttttgatatggctctatcccctattaacatccaactgttggctgaagaccgcttacccagggagactctgcaattcagtaaattatttgatgcctccagcagtcttgttcaaatgcaatggatagctcctcaggttgtttctcagaagggtgaaggtagtgatatctatgatctcctcttcctcaggtttgaaagaggacctttgggtgtgctgttgtttaaactaggcgtcttcactcgaggacagctgggcctgatagacatcatcttccagtacattcactgtgatgagatctatgaggcaataaacatcctgagcagcatgaactgggacactctgggccaccagtgctttatcagcatgagcgccattgtaaaccatcttcttagacagaagctcactccagagagagaagcacagcttgagacaagccttggaaccttctatgctccaacaagaccacttctggattccactatattggaatatagagatcaaatcagcaaatatgcaaggagattcttccatcacttgctcaggtaccagaggtttgaaaaggcatttctcctagctgttgacgttggtgctcgtgacctctttatggatattcattaccttgcactagataaaggtgaattggcactagctgaagtggcaagaaaaagagctagtgacattgatgcagaatcaataacctctggggttgaactcctgggacccttggacagaggggatatgctaaatgaagcatttattggcctgtctttagcacctcaaggagaagactcatttccagataacctccctccctcttgcccaacccacagacatattttacaacaaagaatactgaatggctcttctaacagacaaataattgacagaaggaatgaacttgaaaaagacatctgttctggatttttgatgactaatacctgtaatgcagaagacggagaactgagagaagacggcagagaacaggaaatcagagatggtggttctctcaaaatgattcactttggtctggtgtaaacattaagaaaaaaagaaaactgccttcttcatatctaaacttttcatggcctgatacagacttaaaatcccccgtgtggatttttaacaagagacagtatgaatcatataaattagttaagagttttgagttgagtgtttgttttcaaaataaagttttattatttcaaaaacatgcagcataacagcaaagtgatcgtaagtaaaagtcttcaacctacttattttcaataatgtaaaattttgaaagtgtcttaaattgtatgttaattaggtgctacaaaaatagaatatttaaactttgttctcccaggtactttaaaaaaggggcagtagggggcaggcatagtgctcatgcctgtagtcccagtgctttaggaggccaaggctgaaggatcacttgagcccaggagttcaagactagcctgtgcaacatagtgaaacgctgtctctagaaaaaattttaaaaattagccaggcatggtggtacatgcttgtgaagctgaggcagaagaattgcttgagcccaggagttcaaggctacagtgagctgtgatcgcgccactgcactctaacctgggcaacagagagtgaccctgtctccaaaaa

SEQ ID NO: 437477 - DNA, 2445 bp, Homo sapiens
  misc_feature (2065)..(2065): n is a, c, g, or t
aaattttttaaataaatagactggtagagaacactgatcagtatcccctaataaatccactttatcctcggatggtttctatcatgtaaacataggattaaactcttagcacaaataaaatggaatgttttcgtctctacattcagctcttctcacagacagttttatcatcttatcatttttggcacaaaacaaactatgttttattcagtttaccaagaagatggagtcttctgatgtaaacaaaagactggaaaaactctcagccttggattataagattttctattatgaaatacccggcccaataaacaagacaacagagcgacatctagctatcaactgtgttcatgatagagttgtttgctggtggccactggtcaacgatgatgcttggccttgggcccccatttcttctgagaaggacagagccaatctactcctcctgggttatgctcaaggaagactagaggttctgagttctgtccgcacagaatgggacccactggatgttcgctttggcaccaaacagccttatcaggtgttcacagtggagcactccgtaagtgtagacaaagagcccatggctgacagctgcatctatgaatgcattcggaataaaatccagtgtgtgtcagtcaccagaataccactaaagtcaaaggccatcagctgctgcaggaatgttactgaagacaaactgattctgggctgtgaagattcttcgctaattctttatgaaactcaccgtagagtgactctcttagcacagactgaacttttgccttcattaataagctgccacccaagtggtgccattctgctagttggcagcaaccaaggggagttgcaaatttttgatatggctctatcccctattaacatccaactgttggctgaagaccgcttacccagggagactctgcaattcagtaaattatttgatgcctccagcagtcttgttcaaatgcaatggatagctcctcaggttgtttctcagaagggtgaaggtagtgatatctatgatctcctcttcctcaggtttgaaagaggacctttgggtgtgctgttgtttaaactaggcgtcttcactcgaggacagctgggcctgatagacatcatcttccagtacattcactgtgatgagatctatgaggcaataaacatcctgagcagcatgaactgggacactctgggccaccagtgctttatcagcatgagcgccattgtaaaccatcttcttagacagaagctcactccagagagagaagcacagcttgagacaagccttggaaccttctatgctccaacaagaccacttctggattccactatattggaatatagagatcaaatcagcaaatatgcaaggagattcttccatcacttgctcaggtaccagaggtttgaaaaggcatttctcctagctgttgacgttggtgctcgtgacctctttatggatattcattaccttgcactagataaaggtgaattggcactagctgaagtggcaagaaaaagagctagtgacattgatgcagaatcaataacctctggggttgaactcctgggacccttggacagaggggatatgctaaatgaagcatttattggcctgtctttagcacctcaaggagaagactcatttccagataacctccctccctcttgcccaacccacagacatattttacaacaaagaatactgaatggctcttctaacagacaaataattgacagaaggaatgaacttgaaaaagacatctgttctggatttttgatgactaatacctgtaatgcagaagacggagaactgagagaagacggcagagaacaggaaatcagagatggtggttctctcaaaatgattcactttggtctggtgtaaacattaagaaaaaaagaaaactgccttcttcatatctaaacttttcatggcctgatacagacttaaaatcccccgtgtggatttttaacaagagacagtatgaatcatataaattagttaagagttttgagttgagtgtttgttttcaaaataaagttttattatttcaaaaaaaanaaaatggcctatggggtctctggcctgaacctctgagctctgttgcctttaccgttgattgatggatgatccttgatcattgattacttactctctgccctccggctgtcgggtgcggcaagcggtatctcataagtggaaggccggatttccgctatccacagggttaggggatgacgcaacatgtaacctgtgggccagcggccggccaggagccgtgaaccggccaaggggctcgtggctgtccatatgctataggctcctgacgagtgtcaagcatatcaacactcaactctcaggtgggaggaggcgacacgactctggactatccagatgcctcgcgctggaagctgcatggtgcgttgtgctgtttccagcct

SEQ ID NO: 437478 - DNA, 3226 bp, Homo sapiens
  misc_feature (2846)..(2846): n is a, c, g, or t
acactctggaggggcgggggaattgataagttgggacgaccggacagcttctcaggttgctaagcgacgaggcgggagcgcacgcacaccctggctgctttgtagcacctgaggaaactgtggcggcggcggcggcgtcctggagacccaagagaccaagcgagcgtgtcgctccctctcgggtccgaggacctagcctaggaaccttctgcccggggtagtgtctggtgatgaggcgagagttttgctgggacgcctactccaaagcggccgggagtcgcgcttcttccccactcccgagacaggatagagattccttctgccatcagatgtctttctgcttgactgaactgcacctgtggtctttgaagaataccttacacattgcggatagagacattgggatctaccagtattatgacaagaaagatccaccagcgacagagcatggtaacttagaaaagaagcagaagctggcagagtcacgagattatccttggacgctcaaaaacagacgcccagaaaaactccgagactcgctcaaagagttggaggagctgatgcaaaacagtcggtgtgtgctgagcaaatggaagaacaaatatgtctgtcagctcctttggttcaggtgtgctggtgtctctaagcctttctgggccgcagctggagaaagtggtgattgacagaagcctggtggggaagctcatctcagacaccatcagtgatgctcttctcacagacagttttatcatcttatcatttttggcacaaaacaaactatgttttattcagtttaccaagaagatggagtcttctgatgtaaacaaaagactggaaaaactctcagccttggattataagattttctattatgaaatacccggcccaataaacaagacaacagagcgacatctagctatcaactgtgttcatgatagagttgtttgctggtggccactggtcaacgatgatgcttggccttgggcccccatttcttctgagaaggacagagccaatctactcctcctgggttatgctcaaggaagactagaggttctgagttctgtccgcacagaatgggacccactggatgttcgctttggcaccaaacagccttatcaggtgttcacagtggagcactccgtaagtgtagacaaagagcccatggctgacagctgcatctatgaatgcattcggaataaaatccagtgtgtgtcagtcaccagaataccactaaagtcaaaggccatcagctgctgcaggaatgttactgaagacaaactgattctgggctgtgaagattcttcgctaattctttatgaaactcaccgtagagtgactctcttagcacagactgaacttttgccttcattaataagctgccacccaagtggtgccattctgctagttggcagcaaccaaggggagttgcaaatttttgatatggctctatcccctattaacatccaactgttggctgaagaccgcttacccagggagactctgcaattcagtaaattatttgatgcctccagcagtcttgttcaaatgcaatggatagctcctcaggttgtttctcagaagggtgaaggtagtgatatctatgatctcctcttcctcaggtttgaaagaggacctttgggtgtgctgttgtttaaactaggcgtcttcactcgaggacagctgggcctgatagacatcatcttccagtacattcactgtgatgagatctatgaggcaataaacatcctgagcagcatgaactgggacactctgggccaccagtgctttatcagcatgagcgccattgtaaaccatcttcttagacagaagctcactccagagagagaagcacagcttgagacaagccttggaaccttctatgctccaacaagaccacttctggattccactatattggaatatagagatcaaatcagcaaatatgcaaggagattcttccatcacttgctcaggtaccagaggtttgaaaaggcatttctcctagctgttgacgttggtgctcgtgacctctttatggatattcattaccttgcactagataaaggtgaattggcactagctgaagtggcaagaaaaagagctagtgacattgatgcagaatcaataacctctggggttgaaagagcaactacaataatgaacaccaatatccatggacagcatctacaacaagctttagtgacaacatattcttataaaccccaaaacataagtggacagggataaatcaccaacagctacaggacccactaaaaacttcatgaggtctagagggtccacagtgggtgttgaagcaatgtgatttctgtgcagtcctctgaatgccaacatgaaaaaattcaatgaggctcagagtttgttgaaatggaagagcactggctttgtgccagacatttcagaactcctgggacccttggacagaggggatatgctaaatgaagcatttattggcctgtctttagcacctcaaggagaagactcatttccagataacctccctccctcttgcccaacccacagacatattttacaacaaagaatactgaatggctcttctaacagacggagaactgagagaagacggcagagaacaggaaatcagagatggtggttctctcaaaatgattcactttggtctggtgtaaacattaagaaaaaaagaaaactgccttcttcatatctaaacttttcatggcctgatacagacttaaaatcccccgtgtggatttttaacaagagacagtatgaatcatataaattagttaagagttttgagttgagtgtttgttttcaaaataaagttttattatttcaaaaaaaanaaaatggcctatggggtctctggcctgaacctctgagctctgttgcctttaccgttgattgatggatgatccttgatcattgattacttactctctgccctccggctgtcgggtgcggcaagcggtatctcataagtggaaggccggatttccgctatccacagggttaggggatgacgcaacatgtaacctgtgggccagcggccggccaggagccgtgaaccggccaaggggctcgtggctgtccatatgctataggctcctgacgagtgtcaagcatatcaacactcaactctcaggtgggaggaggcgacacgactctggactatccagatgcctcgcgctggaagctgcatggtgcgttgtgctgtttccagcct

SEQ ID NO: 437479 - DNA, 1133 bp, Homo sapiens
agccttcgttgcagtcgtcactcgcatctggctaccagctccccgctgccctgcgctcggcgggctggcatcgggcccggggaaagcggagcagtagttcggtgtagcactgtttgcggcgaggagaaaggaaggagaggagaaaactgcactggatcaaggaggtcttcccataggcctgcagtagggctgtttaccattggaagcaagggaaagaggaggagatcaatctagaagcatggagatctgcctgcatgtctgctgcagggcttaagatcactggaagcaaagaaacaaagaggagattgctcctgatcagtatagactgggtgtattgccaagagaagcaagaggagaggagggaactgcctcggatcattacaggtgttgatcccaagagcattccctagtaaaaacgcttcatgctgaactctatctctgggcctgcttcctgggaagccaacctgcaacagttggtacaagaagtggttcgagaaagcaaacactgtgatgaaattttggagatgaatcacctgctacccagctgtcaatgaagactccatcattggtggtaggtggagtagataggcctctggaataaggtagcagaggaattgttaaaattttcaatggtggttaactgggttggcatactggtaaaatgggacacattaactggtgccatgtatcagacctttgagaaatatgggatatattaaatataaggaaggccagaaaattgggcggctgttgctaagcagattgagctctggaaaagaataacaaaaagctgaattaaattaatcaacaattgaaagctatgtttgaaagtcagatggctttattcataacatataaagaggctctcatcttttccaggtagaaggtggagaaatctgaggagtagactcaggatttgttaaaagcaagcttcaaagaaagttaaaattctaaccaagacaagtcttctatgccgagttatgtgccatggttaagaaggaatgggactctgacacttggaatgggggacatctggattgatgtccctaaaaatcttatatccccagattcccctgagccccttgagaagtgtcctactcctccctattaagggctggcactccatcttgctt

SEQ ID NO: 437480 - DNA, 1449 bp, Homo sapiens
tttgagtctggagctggggataacaccagcatcaaggataagtttgaggctgctggtggagttgatatagggtcttggttctgtgctggtaatgaaaacacaagtgaggacaaatctgcacctaaggctaaagccaaaaagtcatctgagtcaagaggcatatatccgtacatggtccctggggcaggaatggggtcatgggatggagccatgatctggtcggaaactaagtttgcacatcaaagtgaggccagcttcccagttgaagatgagtccagaaaacaaaccaggactggggaaaaaactcggccctggtcttgccgctgtaaacacgaagctaatatggatccacgagatcttgaaaaactcatttgcatgattgagatgactgaagatccttctgttcatgaaatagccaataatgctttatataacagtgctgattattcttattctcatgaagttgttcgtaatgtaggtggaatttcagttattgaaagcttgctcaataatccctaccccagtgttaggcagaaggctttaaatgcactgaataatatctcagtggctgctgaaaaccataggaaggttaaaacttacttaaaccaagtatgtgaagacactgtcacctatcccttgaattcaaatgtgcagttggctggactaaggttgataaggcatctgactattaccagtgaatatcagcatatggttacaaattatatttcagaatttcttcgtttgttaacggtgggaagtggagaaactaaagaccatgttttgggaatgcttttgaatttctctaaaaatccatctatgacaaaagacttgctcattgccaatgcaccaacatcactgattaacatttttagcaagaaagagacaaaggagaatattcttaatgctctttcactatttgaaaatataaattaccattttaaaagaagagcaaaagcatttacccaggacaaattcagtaaaaattccctttatttcctattccaacgacctaaagcatgtgccaagaaacttcgagccttagcagcagaatgcaatgaccctgaggtgaaagagagagttgagctattaataagtaaactctgattggctgtatgttcccaaacaaatttgagtaatattttggttttgcactctggaagtaatgcacattgtaaattgcattataactttgaaactgatgttacctatgatggtctatagctggaccattttatgaacaccaaatgaattcaagcttgtactaaaaatacatgtgttgatttttatcttgtctggattgagatatttttagtatgcttcatgagcagaaactgaatggattcttcataagtaaggtaatctttggtcctttgtgtggacttatgtttatacatttaagactatttttatgtcatcaataaagttgtgtgttttaagcagcagaaaaaa

SEQ ID NO: 437481 - DNA, 1178 bp, Homo sapiens
agccttcgttgcagtcgtcactcgcatctggctaccagctccccgctgccctgcgctcggcgggctggcatcgggcccggggaaagcggagcagtagttcggtgtagcactgtttgcggcgaggagaaaggaaggagaggagaaaactgcactggatcaaggaggtcttcccataggcctgcagtagggctgtttaccattggaagcaagggaaagaggaggagatcaatctagaagcatggagatctgcctgcatgtctgctgcagggcttaagatcactggaagcaaagaaacaaagaggagattgctcctgatcagtatagactgggtgtattgccaagagaagcaagaggagaggagggaactgcctcggatcattacaggtccacctccagaggcagctgtagtggcctttgagtggctgaagaccagcaccctcacaggcctacacccacaactaccactctctttaccccagcccgagtgcgctctaccataccttgttcgtgcttttagcaggggtgattacatgggccgcattcaggaagtgggctgggtgactgcaggactggtgatctgggctggcacctgctactacatttacaaatttaccaagggaagagcccagagtgtgaggactcttgccagaaatggatccacagttaagatggagactgtggttggggtacagagccagaccttggccataaatgaagcagagattaagactaaaccccaagtcgagattggagcagaaactggagcaagaagtgggcctggggctgaagtagagaccaaggccactgctatactattaataagtaaactctgattggctgtatgttcccaaacaaatttgagtaatattttggttttgcactctggaagtaatgcacattgtaaattgcattataactttgaaactgatgttacctatgatggtctatagctggaccattttatgaacaccaaatgaattcaagcttgtactaaaaatacatgtgttgatttttatcttgtctggattgagatatttttagtatgcttcatgagcagaaactgaatggattcttcataagtaaggtaatctttggtcctttgtgtggacttatgtttatacatttaagactatttttatgtcatcaataaagttgtgtgttttaagcagcagaaaaaa

SEQ ID NO: 437482 - DNA, 1110 bp, Homo sapiens
cgataggcgacgcggggagcggaagccctttacactacggtgtttccggcttcaagatggtcgcctaagctgtttagtgaaacttcttccacctttctccattcctctaggtgctttttctgaacctggatgtgaggcattaaaggatccgacggaaatagaattgaaggcattctaaaatggctaaccgtacagtgaaggatgcgcacagcatccatggcaccaaccctcaatatctggtggagaagatcattcgaacgcgaatctatgagtccaagtactggaaagaggagtgctttggacttacagctgaacttgtagtcgataaagccatggagttaagaaacgctatgtattagaggaagctgagcaactggagcctcgagttagtgctctggaagaggacatggatgatgtggagtccagtgaagaggaagaagaggaggatgagaagttggaaagagtgccatcacctgatcaccgccggagaagctaccgagacttggacaagccccgtcgctctcccacactgcgctacaggaggagtaggagccggtctcccagaaggcggagtcgatctcccaaaaggagaagcccctcccctcgccgagaaaggcatcggagcaagagtccaagacgtcaccgcagcaggtcccgagatcggcggcacagatcccgttccaagtccccaggtcatcaccgtagtcacagacacaggagccactcaaagtctcccgaaaggtctaagaagagccacaagaagagccggagagggaatgagtaatggactcagtttggttttagtccacatggcctcctgtggatataaggatatctgtatgtggaaggattaagatctcccccaggcagctataagaatattttagtttttttcttatcaagtttctcaacctttatttttaatgaaggaggtgctgagttttgtatctttttaatcataatcaacatcagtttttgacccaactaaccttgactgtattcaaacttatgagagtataaaggatctggaggttggggatatgactgacaaggaaaggctgtggccacctgatgaccctttccctttttattaaaccggacacacctgtt

SEQ ID NO: 437483 - DNA, 807 bp, Homo sapiens
cgggccccaggaacaccaggccgagcaaaaccaagcggattaccggccctcgtgccatttcggcacgagctggtccgaaattcgcctcatggttttgacctaaattgctagacagtcgtgccattcacaaagtcagaaaatacagcaggaagagacagcttttagaggggcagagaattagaggatggtggtagtaatgaaaatgatgcattcagtttaacaagtttaatttgagacagctatggtatagctaaaaacaaaagcccataaagttggagatagggaccagagtttaacatagcgatctaggccagaattgacaatgtttaagtaatggtggaatctgtcaataagacttcccagagtgttaatatatatcagaaatgcacacaacagaaccataggcaacaccaacacaggaagaaatagaagtcacctattgaaaactggaatggcccattcagaaagacaggagaattaggagagagtgagtgaaagaagccaagggtcaagaatgcagaagcaaaggaaggactaaaaagcctccacggacatcgataatcaagagattattaagatctttgctagaagagttcctttacctgtacttaactcccttaaaaagagaaaagtgatggaatgacttctgcaactgtagtcccagcaggaactgtgaagaccagctgccctgcaggatccagtttttcttgggaggttgtatctggtcataaggtaaacattctatatattctatgcctgctctagaattgaaagacttcagcagtattaaagcattttttaatctta

SEQ ID NO: 437484 - DNA, 813 bp, Homo sapiens
agccccaaccccgggcccagaccaaccgggcgagagagcaacgggcaaaccgcccttggtccgattcggcccgagctcgggccgattcggcgccaaggtttttgattaatatgtaagacagtcgtgccattcacaaagtcagaaaatacagcaggaagagacagcttttagaggggcagagaattagaggatggtggtagtaatgaaaatgatgcattcagtttaacaagtttaatttgagacagctatggtatagctaaaaacaaaagcccataaagttggagatagggaccagagtttaacatagcgatctaggccagaattgacaatgtttaagtaatggtggaatctgtcaataagacttcccagagtgttaatatatatcagaaatgcacacaacagaaccataggcaacaccaacacaggaagaaatagaagtcacctattgaaaactggaatggcccattcagaaagacaggagaattaggagagagtgagtgaaagaagccaagggtcaagaatgcagaagcaaaggaaggactaaaaagcctccacggacatcgataatcaagagattattaagatctttgctagaagagttcctttacctgtacttaactcccttaaaaagagaaaagtgatggaatgacttctgcaactgtagtcccagcaggaactgtgaagaccagctgccctgcaggatccagtttttcttgggaggttgtatctggtcataaggtaaacattctatatattctatgcctgctctagaattgaaagacttcagcagtattaaagcattttttaatctta

SEQ ID NO: 437485 - DNA, 389 bp, Homo sapiens
tttcgccatgttggccaggcctgtcttgaactcctaacctcaagtgatctgcctgccttggcctcccaaagtgctgggattacaggcgtgagccaccactcctagccagttctcaaaagctatcactccatgtgccatataagatacatgttctaaattcagaaacattgaaggttcagatgagaaattatatttgagttatatgatctcttcaagatcatccctacataattcaggactgtttgtgcttgtttttgtgtttgtctcctgctaattgggacatcttcattcatcccttaatctcttctaaagaggcctagcacatagatgtcctgatatgaagtcttaacacttcttttactttttggcatctaaatcttttatttcca

SEQ ID NO: 437486 - DNA, 2607 bp, Homo sapiens
cgataggcgacgcggggagcggaagccctttacactacggtgtttccggcttcaagatggtcgcctaagctgtttagtgaaacttcttccacctttctccattcctctaggtgctttttctgaacctggatgtgaggcattaaaggatccgacggaaatagaattgaaggcattctaaaatggctaaccgtacagtgaaggatgcgcacagcatccatggcaccaaccctcaatatctggtggagaagatcattcgaacgcgaatctatgagtccaagtactggaaagaggagtgctttggacttacagctgaacttgtagtcgataaagccatggagttaaggtttgtgggtggcgtctatggtggcaacataaaaccaacaccctttctgtgtttaaccttgaagatgcttcaaattcaacccgagaaggatatcattgtagagtttatcaaaaatgaagatttcaagtatgtccgcatgctgggggcactttacatgaggctgacaggcactgcaattgattgctacaagtacttggaacctttgtacaatgactatcgaaaaatcaagagccagaaccgaaatggggagtttgaattgatgcatgttgatgagtttattgatgaactattgcacagtgagagagtctgtgatatcattctgccccgactacagaaacgctatgtattagaggaagctgagcaactggagcctcgagttagtgctctggaagaggacatggatgatgtggagtccagtgaagaggaagaagaggaggatgagaagttggaaagagtgccatcacctgatcaccgccggagaagctaccgagacttggacaagccccgtcgctctcccacactgcgctacaggaggagtaggagccggtctcccagaaggcggagtcgatctcccaaaaggagaagcccctcccctcgccgagaaaggcatcggagcaagagtccaagacgtcaccgcagcaggtcccgagatcggcggcacagatcccgttccaagtccccaggtcatcaccgtagtcacagacacaggagccactcaaagtctcccgaaaggtctaagaagagccacaagaagagccggagagggaatgagtaatggactcagtttggttttagtccacatggcctcctgtggatataaggatatctgtatgtggaaggattaagatctcccccaggcagctataagaatattttagtttttttcttatcaagtttctcaacctttatttttaatgaaggaggtgctgagttttgtatctttttaatcataatcaacatcagtttttgacccaactaaccttgactgtattcaaacttatgagagtataaaggatctggaggttggggatatgactgacaaggaaaggctgtggccacctgatgaccctttccctttttattaaaccggacacacctgtttcccatttcgctgtagtttagtttttggtttgttgtggttggaactgctttgagaatcctgggatttgtgctgctgctgttattcaaagatcaaaggagtaaaacatagttgctcctaacttttttccagcagcagcaagtggtaataaacatgaaaactggtttgtagcagttttgaaagaatagaatgcattcaaatgtaaggctgcttctggatcattaaagccagtttcatcaaacagttcaacagagagcagcacttaataccctttatacagcccattttttcatagtttcatttgttcttgcccacaagcttgaaatccaggttaaggtatccagcctttatcatataagcattgacattatccaggcctagtcagtagcagtagggtaacgggattgaaaaagatttgatggagaggaaagtatctaatattagtcatggttttgacctaaattgctagacagtcgtgccattcacaaagtcagaaaatacagcaggaagagacagcttttagaggggcagagaattagaggatggtggtagtaatgaaaatgatgcattcagtttaacaagtttaatttgagacagctatggtatagctaaaaacaaaagcccataaagttggagatagggaccagagtttaacatagcgatctaggccagaattgacaatgtttaagtaatggtggaatctgtcaataagacttcccagagtgttaatatatatcagaaatgcacacaacagaaccataggcaacaccaacacaggaagaaatagaagtcacctattgaaaactggaatggcccattcagaaagacaggagaattaggagagagtgagtgaaagaagccaagggtcaagaatgcagaagcaaaggaaggactaaaaagcctccacggacatcgataatcaagagattattaagatctttgctagaagagttcctttacctgtacttaactcccttaaaaagagaaaagtgatggaatgacttctgcaactgtagtcccagcaggaactgtgaagaccagctgccctgcaggatccagtttttcttgggaggttgtatctggtcataaggtaaacattctatatattctatgcctgctctagaattgaaagacttcagcagtattaaagcattttttaatctta

SEQ ID NO: 437487 - DNA, 2422 bp, Homo sapiens
cgataggcgacgcggggagcggaagccctttacactacggtgtttccggcttcaagatggtcgcctaagctgtttagtgaaacttcttccacctttctccattcctctaggtgctttttctgaacctggatgtgaggcattaaaggatccgacggaaatagaattgaaggcattctaaaatggctaaccgtacagtgaaggatgcgcacagcatccatggcaccaaccctcaatatctggtggagaagatcattcgaacgcgaatctatgagtccaagtactggaaagaggagtgctttggacttacagctgaacttgtagtcgataaagccatggagttaagaaacgctatgtattagaggaagctgagcaactggagcctcgagttagtgctctggaagaggacatggatgatgtggagtccagtgaagaggaagaagaggaggatgagaagttggaaagagtgccatcacctgatcaccgccggagaagctaccgagacttggacaagccccgtcgctctcccacactgcgctacaggaggagtaggagccggtctcccagaaggcggagtcgatctcccaaaaggagaagcccctcccctcgccgagaaaggcatcggagcaagagtccaagacgtcaccgcagcaggtcccgagatcggcggcacagatcccgttccaagtccccaggtcatcaccgtagtcacagacacaggagccactcaaagtctcccgaaaggtctaagaagagccacaagaagagccggagagggaatgagtaatggactcagtttggttttagtccacatggcctcctgtggatataaggatatctgtatgtggaaggattaagatctcccccaggcagctataagaatattttagtttttttcttatcaagtttctcaacctttatttttaatgaaggaggtgctgagttttgtatctttttaatcataatcaacatcagtttttgacccaactaaccttgactgtattcaaacttatgagagtataaaggatctggaggttggggatatgactgacaaggaaaggctgtggccacctgatgaccctttccctttttattaaaccggacacacctgtttcccatttcgctgtagtttagtttttggtttgttgtggttggaactgctttgagaatcctgggatttgtgctgctgctgttattcaaagatcaaaggagtaaaacatagttgctcctaacttttttccagcagcagcaagtggtaataaacatgaaaactggtttgtagcagttttgaaagaatagaatgcattcaaatgtaaggctgcttctggatcattaaagccagtttcatcaaacagttcaacagagagcagcacttaataccctttatacagcccattttttcatagtttcatttgttcttgcccacaagcttgaaatccaggttaaggtatccagcctttatcatataagcattgacattatccaggcctagtcagtagcagtagggtaacgggattgaaaaagatttgatggagaggaaagtatctaatattagtcatggttttgacctaaattgctagacagtcgtgccattcacaaagtcagaaaatacagcaggaagagacagcttttagaggggcagagaattagaggatggtggtagtaatgaaaatgatgcattcagtttaacaagtttaatttgagacagctatggtatagctaaaaacaaaagcccataaagttggagatagggaccagagtttaacatagcgatctaggccagaattgacaatgtttaagtaatggtggaatctgtcaataagacttcccagagtgttaatatatatcagaaatgcacacaacagaaccataggcaacaccaacacaggaagaaatagaagtcacctattgaaaactggaatggcccattcagaaagacaggagaattaggagagagtgagtgaaagaagccaagggtcaagaatgcagaagcaaaggaaggactaaaaagcctccacggacatcgataatcaagagattattaagatctttgctagaagagttcctttacctgtacttaactcccttaaaaagagaaaagtgatggaatgacttctgcaactgtagtcccagcaggaactgtgaagaccagctgccctgcaggatccagtttttcttgggaggttgtatctggtcataaggtaaacattctatatattctatgcctgctctagaattgaaagacttcagcagtattaaagcattttttaatcttatttgagctttcatattcttcaatggttcctttcgtaatacctgagttaataaaagtggtctgaaagagctcttacggtttctgatagaactatataggactaccttttaagattaaatataagcatctgtacgtaaatgtaaaaaagtg

SEQ ID NO: 437488 - DNA, 2340 bp, Homo sapiens
cgataggcgacgcggggagcggaagccctttacactacggtgtttccggcttcaagatggtcgcctaagctgtttagtgaaacttcttccacctttctccattcctctaggtgctttttctgaacctggatgtgaggcattaaaggatccgacggaaatagaattgaaggcattctaaaatggctaaccgtacagtgaaggatgcgcacagcatccatggcaccaaccctcaatatctggtggagaagatcattcgaacgcgaatctatgagtccaagtactggaaagaggagtgctttggacttacagctgaacttgtagtcgataaagccatggagttaagaaacgctatgtattagaggaagctgagcaactggagcctcgagttagtgctctggaagaggacatggatgatgtggagtccagtgaagaggaagaagaggaggatgagaagttggaaagagtgccatcacctgatcaccgccggagaagctaccgagacttggacaagccccgtcgctctcccacactgcgctacaggaggagtaggagccggtctcccagaaggcggagtcgatctcccaaaaggagaagcccctcccctcgccgagaaaggcatcggagcaagagtccaagacgtcaccgcagcaggtcccgagatcggcggcacagatcccgttccaagtccccaggtcatcaccgtagtcacagacacaggagccactcaaagtctcccgaaaggtctaagaagagccacaagaagagccggagagggaatgagtaatggactcagtttggttttagtccacatggcctcctgtggatataaggatatctgtatgtggaaggattaagatctcccccaggcagctataagaatattttagtttttttcttatcaagtttctcaacctttatttttaatgaaggaggtgctgagttttgtatctttttaatcataatcaacatcagtttttgacccaactaaccttgactgtattcaaacttatgagagtataaaggatctggaggttggggatatgactgacaaggaaaggctgtggccacctgatgaccctttccctttttattaaaccggacacacctgtttcccatttcgctgtagtttagtttttggtttgttgtggttggaactgctttgagaatcctgggatttgtgctgctgctgttattcaaagatcaaaggagtaaaacatagttgctcctaacttttttccagcagcagcaagtggtaataaacatgaaaactggtttgtagcagttttgaaagaatagaatgcattcaaatgtaaggctgcttctggatcattaaagccagtttcatcaaacagttcaacagagagcagcacttaataccctttatacagcccattttttcatagtttcatttgttcttgcccacaagcttgaaatccaggttaaggtatccagcctttatcatataagcattgacattatccaggcctagtcagtagcagtagggtaacgggattgaaaaagatttgatggagaggaaagtatctaatattagtcatggttttgacctaaattgctagacagtcgtgccattcacaaagtcagaaaatacagcaggaagagacagcttttagaggggcagagaattagaggatggtggtagtaatgaaaatgatgcattcagtttaacaagtttaatttgagacagctatggtatagctaaaaacaaaagcccataaagttggagatagggaccagagtttaacatagcgatctaggccagaattgacaatgtttaagtaatggtggaatctgtcaataagacttcccagagtgttaatatatatcagaaatgcacacaacagaaccataggcaacaccaacacaggaagaaatagaagtcacctattgaaaactggaatggcccattcagaaagacaggagaattaggagagagtgagtgaaagaagccaagggtcaagaatgcagaagcaaaggaaggactaaaaagcctccacggacatcgataatcaagagattattaagatctttgctagaagagttcctttacctgtacttaactcccttaaaaagagaaaagtgatggaatgacttctgcaactgtagtcccagcaggaactgtgaagaccagctgccctgcaggatccagtttttcttgggaggttgtatctggtcataaggtaaacattctatatattctatgcctgctctagaattgaaagacttcagcagtattaaagcattttttaatcttatttgagctttcatattcttcaatggttcctttcgtaatacctgagttaataaaagtggtctgaaaga

SEQ ID NO: 437489 - DNA, 1799 bp, Homo sapiens
cgataggcgacgcggggagcggaagccctttacactacggtgtttccggcttcaagatggtcgcctaagctgtttagtgaaacttcttccacctttctccattcctctaggtgctttttctgaacctggatgtgaggcattaaaggatccgacggaaatagaattgaaggcattctaaaatggctaaccgtacagtgaaggatgcgcacagcatccatggcaccaaccctcaatatctggtggagaagatcattcgaacgcgaatctatgagtccaagtactggaaagaggagtgctttggacttacagctgaacttgtagtcgataaagccatggagttaagaaacgctatgtattagaggaagctgagcaactggagcctcgagttagtgctctggaagaggacatggatgatgtggagtccagtgaagaggaagaagaggaggatgagaagttggaaagagtgccatcacctgatcaccgccggagaagctaccgagacttggacaagccccgtcgctctcccacactgcgctacaggaggagtaggagccggtctcccagaaggcggagtcgatctcccaaaaggagaagcccctcccctcgccgagaaaggcatcggagcaagagtccaagacgtcaccgcagcaggtcccgagatcggcggcacagatcccgttccaagtccccaggtcatcaccgtagtcacagacacaggagccactcaaagtctcccgaaaggtctaagaagagccacaagaagagccggagagggaatgagtaatggactcagtttggttttagtccacatggcctcctgtggatataaggatatctgtatgtggaaggattaagatctcccccaggcagctataagaatattttagtttttttcttatcaagtttctcaacctttatttttaatgaaggaggtgctgagttttgtatctttttaatcataatcaacatcagtttttgacccaactaaccttgactgtattcaaacttatgagagtataaaggatctggaggttggggatatgactgacaaggaaaggctgtggccacctgatgaccctttccctttttattaaaccggacacacctgtttcccatttcgctgtagtttagtttttggtttgttgtggttggaactgctttgagaatcctgggatttgtgctgctgctgttattcaaagatcaaaggagtaaaacatagttgctcctaacttttttccagcagcagcaagtggtaataaacatgaaaactggtttgtagcagttttgaaagaatagaatgcattcaaatgtaaggctgcttctggatcattaaagccagtttcatcaaacagttcaacagagagcagcacttaataccctttatacagcccattttttcatagtttcatttgttcttgcccacaagcttgaaatccaggttaaggtatccagcctttatcatataagcattgacattatccaggcctagtcagtagcagtagggtaacgggattgaaaaagatttgatggagaggaaagtatctaatattagtcatggttttgacctaaattgctagacagtcgtgccattcacaaagtcagaaaatacagcaggaagagacagcttttagaggggcagagaattagaggatggtggtagtaatgaaaatgatgcattcagtttaacaagtttaatttgagacagctatggtatagctaaaaacaaaagcccataaagttggagatagggaccagagtttaacatagcggtgagggcgtacctcaaggggccgagccta

SEQ ID NO: 437490 - DNA, 1426 bp, Homo sapiens
cgataggcgacgcggggagcggaagccctttacactacggtgtttccggcttcaagatggtcgcctaagctgtttagtgaaacttcttccacctttctccattcctctaggtgctttttctgaacctggatgtgaggcattaaaggatccgacggaaatagaattgaaggcattctaaaatggctaaccgtacagtgaaggatgcgcacagcatccatggcaccaaccctcaatatctggtggagaagatcattcgaacgcgaatctatgagtccaagtactggaaagaggagtgctttggacttacagctgaacttgtagtcgataaagccatggagttaagaaacgctatgtattagaggaagctgagcaactggagcctcgagttagtgctctggaagaggacatggatgatgtggagtccagtgaagaggaagaagaggaggatgagaagttggaaagagtgccatcacctgatcaccgccggagaagctaccgagacttggacaagccccgtcgctctcccacactgcgctacaggaggagtaggagccggtctcccagaaggcggagtcgatctcccaaaaggagaagcccctcccctcgccgagaaaggcatcggagcaagagtccaagacgtcaccgcagcaggtcccgagatcggcggcacagatcccgttccaagtccccaggtcatcaccgtagtcacagacacaggagccactcaaagtctcccgaaaggtctaagaagagccacaagaagagccggagagggaatgagtaatggactcagtttggttttagtccacatggcctcctgtggatataaggatatctgtatgtggaaggattaagatctcccccaggcagctataagaatattttagtttttttcttatcaagtttctcaacctttatttttaatgaaggaggtgctgagttttgtatctttttaatcataatcaacatcagtttttgacccaactaaccttgactgtattcaaacttatgagagtataaaggatctggaggttggggatatgactgacaaggaaaggctgtggccacctgatgaccctttccctttttattaaaccggacacacctgtttggcccgcacatccgtactggcccgcgggccagtacggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccggcctgagggcccgtcctaggaatggatgtg

SEQ ID NO: 437491 - DNA, 555 bp, Homo sapiens
gggattacaggcgtgagccaccactcctagccagttctcaaaagctatcactccatgtgccatataagatacatgttctaaattcagaaacattgaaggttcagatgagaaattatatttgagttatatgatctcttcaagatcatccctacataattcaggactgtttgtgcttgtttttgtgtttgtctcctgctaattgggacatcttcattcatcccttaatctcttctaaagaggcctagcacatagatgtcctgatatgaagtcttaacacttcttttactttttggcatctaaatcttttatttccaggttgtttgctctaatgactttttcttgcagagtttgaattgatgcatgttgatgagtttattgatgaactattgcacagtgagagagtctgtgatatcattctgccccgactacaggtaagaaataaaagtctgttaccagagtcacccttctcttcctagacgggcagacagacaaacacatacacacagcttaaacactgaagcctgtggatcttatgggtcctcttaatgaatagtc

SEQ ID NO: 437492 - DNA, 287 bp, Homo sapiens
tttttccagtatctgcttttatcacatttgcaaatatctcattagccaaagcgagtcatgtcaccagtcctaaagttagaatgggagggtgctagagttacgtgacaaaagacatggatacagaggtgggtgatacagagaagcgtgaaggataagattggggccgtttttgcaatctaccacatccagtgcgccaacctaggctttcttcttcctctcctctttataggcggagtcgatctcccaaaaggagaaggtaggccttcagtcatttgtgatgaaggata

SEQ ID NO: 437493 - DNA, 774 bp, Homo sapiens
cgataggcgacgcggggagcggaagccctttacactacggtgtttccggcttcaagatggtcgcctaagctgtttagtgaaacttcttccacctttctccattcctctaggtgctttttctgaacctggatgtgaggcattaaaggatccgacggaaatagaattgaaggcattctaaaatggctaaccgtacagtgaaggatgcgcacagcatccatggcaccaaccctcaatatctggtggagaagatcattcgaacgcgaatctatgagtccaagtactggaaagaggagtgctttggacttacagctgaacttgtagtcgataaagccatggagttaaggtttgtgggtggcgtctatggtggcaacataaaaccaacaccctttctgtgtttaaccttgaagatgcttcaaattcaacccgagaaggatatcattgtagagtttatcaaaaatgaagatttcaagtatgtccgcatgctgggggcactttacatgaggctgacaggcactgcaattgattgctacaagtacttggaacctttgtacaatgactatcgaaaaatcaagagccagaaccgaaatgggggtaagtatggtgctaagtctcctgattgtcatttttaagccagtttttattttaccagtacttctacctttgcattgtcatagacagtgtgaatgctccttttcatctacattgttactgtctctatgcaggttttcccttgtccctcatgggagttttcagtctgactactagcttcgtgtt

SEQ ID NO: 437494 - DNA, 2273 bp, Homo sapiens
cgataggcgacgcggggagcggaagccctttacactacggtgtttccggcttcaagatggtcgcctaagctgtttagtgaaacttcttccacctttctccattcctctaggtgctttttctgaacctggatgtgaggcattaaaggatccgacggaaatagaattgaaggcattctaaaatggctaaccgtacagtgaaggatgcgcacagcatccatggcaccaaccctcaatatctggtggagaagatcattcgaacgcgaatctatgagtccaagtactggaaagaggagtgctttggacttacagctgaacttgtagtcgataaagccatggagttaagaaacgctatgtattagaggaagctgagcaactggagcctcgagttagtgctctggaagaggacatggatgatgtggagtccagtgaagaggaagaagaggaggatgagaagttggaaagagtgccatcacctgatcaccgccggagaagctaccgagacttggacaagccccgtcgctctcccacactgcgctacaggaggagtaggagccggtctcccagaaggcggagtcgatctcccaaaaggagaagcccctcccctcgccgagaaaggcatcggagcaagagtccaagacgtcaccgcagcaggtcccgagatcggcggcacagatcccgttccaagtccccaggtcatcaccgtagtcacagacacaggagccactcaaagtctcccgaaaggtctaagaagagccacaagaagagccggagagggaatgagtaatggactcagtttggttttagtccacatggcctcctgtggatataaggatatctgtatgtggaaggattaagatctcccccaggcagctataagaatattttagtttttttcttatcaagtttctcaacctttatttttaatgaaggaggtgctgagttttgtatctttttaatcataatcaacatcagtttttgacccaactaaccttgactgtattcaaacttatgagagtataaaggatctggaggttggggatatgactgacaaggaaaggctgtggccacctgatgaccctttccctttttattaaaccggacacacctgtttcccatttcgctgtagtttagtttttggtttgttgtggttggaactgctttgagaatcctgggatttgtgctgctgctgttattcaaagatcaaaggagtaaaacatagttgctcctaacttttttccagcagcagcaagtggtaataaacatgaaaactggtttgtagcagttttgaaagaatagaatgcattcaaatgtaaggctgcttctggatcattaaagccagtttcatcaaacagttcaacagagagcagcacttaataccctttatacagcccattttttcatagtttcatttgttcttgcccacaagcttgaaatccaggttaaggtatccagcctttatcatataagcattgacattatccaggcctagtcagtagcagtagggtaacgggattgaaaaagatttgatggagaggaaagtatctaatattagtcatggttttgacctaaattgctagacagtcgtgccattcacaaagtcagaaaatacagcaggaagagacagcttttagaggggcagagaattagaggatggtggtagtaatgaaaatgatgcattcagtttaacaagtttaatttgagacagctatggtatagctaaaaacaaaagcccataaagttggagatagggaccagagtttaacatagcgatctaggccagaattgacaatgtttaagtaatggtggaatctgtcaataagacttcccagagtgttaatatatatcagaaatgcacacaacagaaccataggcaacaccaacacaggaagaaatagaagtcacctattgaaaactggaatggcccattcagaaagacaggagaattaggagagagtgagtgaaagaagccaagggtcaagaatgcagaagcaaaggaaggactaaaaagcctccacggacatcgataatcaagagattattaagatctttgctagaagagttcctttacctgtacttaactcccttaaaaagagaaaagtgatggaatgacttctgcaactgtagtcccagcaggaactgtgaagaccagctgccctgcaggatccagtttttcttgggaggttgtatctggtcataaggtaaacattctatatattctatgcctgctctagaattgaaagacttcagcagtattaaagcattttttaatctta

SEQ ID NO: 437495 - DNA, 1865 bp, Homo sapiens
gaggatccccggcgtaggtagaagtagaggttaaggagggtgttagttggaaagagtgccatcacctgatcaccgccggagaagctaccgagacttggacaagccccgtcgctctcccacactgcgctacaggaggagtaggagccggtctcccagaaggcggagtcgatctcccaaaaggagaagcccctcccctcgccgagaaaggcatcggagcaagagtccaagacgtcaccgcagcaggtcccgagatcggcggcacagatcccgttccaagtccccaggtcatcaccgtagtcacagacacaggagccactcaaagtctcccgaaaggtctaagaagagccacaagaagagccggagagggaatgagtaatggactcagtttggttttagtccacatggcctcctgtggatataaggatatctgtatgtggaaggattaagatctcccccaggcagctataagaatattttagtttttttcttatcaagtttctcaacctttatttttaatgaaggaggtgctgagttttgtatctttttaatcataatcaacatcagtttttgacccaactaaccttgactgtattcaaacttatgagagtataaaggatctggaggttggggatatgactgacaaggaaaggctgtggccacctgatgaccctttccctttttattaaaccggacacacctgtttcccatttcgctgtagtttagtttttggtttgttgtggttggaactgctttgagaatcctgggatttgtgctgctgctgttattcaaagatcaaaggagtaaaacatagttgctcctaacttttttccagcagcagcaagtggtaataaacatgaaaactggtttgtagcagttttgaaagaatagaatgcattcaaatgtaaggctgcttctggatcattaaagccagtttcatcaaacagttcaacagagagcagcacttaataccctttatacagcccattttttcatagtttcatttgttcttgcccacaagcttgaaatccaggttaaggtatccagcctttatcatataagcattgacattatccaggcctagtcagtagcagtagggtaacgggattgaaaaagatttgatggagaggaaagtatctaatattagtcatggttttgacctaaattgctagacagtcgtgccattcacaaagtcagaaaatacagcaggaagagacagcttttagaggggcagagaattagaggatggtggtagtaatgaaaatgatgcattcagtttaacaagtttaatttgagacagctatggtatagctaaaaacaaaagcccataaagttggagatagggaccagagtttaacatagcgatctaggccagaattgacaatgtttaagtaatggtggaatctgtcaataagacttcccagagtgttaatatatatcagaaatgcacacaacagaaccataggcaacaccaacacaggaagaaatagaagtcacctattgaaaactggaatggcccattcagaaagacaggagaattaggagagagtgagtgaaagaagccaagggtcaagaatgcagaagcaaaggaaggactaaaaagcctccacggacatcgataatcaagagattattaagatctttgctagaagagttcctttacctgtacttaactcccttaaaaagagaaaagtgatggaatgacttctgcaactgtagtcccagcaggaactgtgaagaccagctgccctgcaggatccagtttttcttgggaggttgtatctggtcataaggtaaacattctatatattctatgcctgctctagaattgaaagacttcagcagtattaaagcattttttaatctta

SEQ ID NO: 437496 - DNA, 1444 bp, Homo sapiens
cgataggcgacgcggggagcggaagccctttacactacggtgtttccggcttcaagatggtcgcctaagctgtttagtgaaacttcttccacctttctccattcctctaggtgctttttctgaacctggatgtgaggcattaaaggatccgacggaaatagaattgaaggcattctaaaatggctaaccgtacagtgaaggatgcgcacagcatccatggcaccaaccctcaatatctggtggagaagatcattcgaacgcgaatctatgagtccaagtactggaaagaggagtgctttggacttacagctgaacttgtagtcgataaagccatggagttaaggtttgtgggtggcgtctatggtggcaacataaaaccaacaccctttctgtgtttaaccttgaagatgcttcaaattcaacccgagaaggatatcattgtagagtttatcaaaaatgaagatttcaagtatgtccgcatgctgggggcactttacatgaggctgacaggcactgcaattgattgctacaagtacttggaacctttgtacaatgactatcgaaaaatcaagagccagaaccgaaatggggagtttgaattgatgcatgttgatgagtttattgatgaactattgcacagtgagagagtctgtgatatcattctgccccgactacagaaacgctatgtattagaggaagctgagcaactggagcctcgagttagtgctctggaagaggacatggatgatgtggagtccagtgaagaggaagaagaggaggatgagaagttggaaagagtgccatcacctgatcaccgccggagaagctaccgagacttggacaagccccgtcgctctcccacactgcgctacaggaggagtaggagccggtctcccagaaggcggagtcgatctcccaaaaggagaagcccctcccctcgccgagaaaggcatcggagcaagagtccaagacgtcaccgcagcaggtcccgagatcggcggcacagatcccgttccaagtccccaggtcatcaccgtagtcacagacacaggagccactcaaagtctcccgaaaggtctaagaagagccacaagaagagccggagagggaatgagtaatggactcagtttggttttagtccacatggcctcctgtggatataaggatatctgtatgtggaaggattaagatctcccccaggcagctataagaatattttagtttttttcttatcaagtttctcaacctttatttttaatgaaggaggtgctgagttttgtatctttttaatcataatcaacatcagtttttgacccaactaaccttgactgtattcaaacttatgagagtataaaggatctggaggttggggatatgactgacaaggaaaggctgtggccacctgatgaccctttccctttttattaaaccggacacacctgtt

SEQ ID NO: 437497 - DNA, 1733 bp, Homo sapiens
agcggaggcgcagagtccgcgcggcggcgcccctctccctccgcagtactccggacggcgcccgcctcgattttcccaggcgagggcacgcccgcgtcagtcgcctccggggcaccttcctcgccacgacacgcagaattaattatctgaagaaatggatacttctccctccagaaaatatccagttaaaaaacgggtgaaaatacatcccaacacagtgatggtgaaatatacttctcattatccccagcctggcgatgatggatatgaagaaatcaatgaaggctatgggaattttatggaggaaaatccaaagaaaggtctgctgagtgaaatgaaaaaaaaagggagagctttctttggaaccatggataccctacctccaccaacagaagacccaatgatcaatgagattggacaattccagagctttgcagaaaaaaacatttttcaatcccgaaaaatgtggatagtgctgtttggatctgctttggctcatggatgtgtagctcttatcactaggcttgtttctgatcggtctaaagttccatctctagaactgatttttatccgttctgtttttcaggtcttatctgtgttagttgtgtgttactatcaggaggccccctttggacccagtggatacagattacgactcttcttttatggtgtatgcaatgtcatttctatcacttgtgcttatacatcattttcaatagttcctcccagcaatgggaccactatgtggagagccacaactacagtcttcagtgccattttggcttttttactcgtagatgagaaaatggcttatgttgacatggctacagttgtttgcagcatcttaggtgtttgtcttgtcatgatcccaaacattgttgatgaagacaattctttgttaaatgcctggaaagaagcctttgggtacaccatgactgtgatggctggactgaccactgctctctcaatgatagtatacagatccatcaaggagaagatcagcatgtggactgcactgtttacttttggttggactgggacaatttggggaatatctactatgtttattcttcaagaacccatcatcccattagatggagaaacctggagttatctcattgctatatgtgtctgttctactgcagcattcttaggagtttattatgccttggacaaattccatccagctttggttagcacagtacaacatttggagattgtggtagctatggtcttgcagcttctcgtgctgcacatatttcctagcatctatgatgtttttggaggggtaatcattatgattagtgtttttgtccttgctggctataaactttactggaggaatttaagaaggcaggactaccaggaaatactagactctcccattaaatgaatacctgattattattgtctcattaatgttcagttattaatatgtatactgccattttaatgtttacctatgaatgtcttttgtgttatataactgacagagtgctataaaatatataatatatacaaatgcagaaaatttattctagtctaatatattcaaatacaaatattaaatatatgaaatacgttatgaatctggtatctttattggtatttatgggtgtctttccaggtaaattgtagtagaaggagaatgttaactgctattactaaataatagaagactcaaagaaatgacccctttcagatggaactgaagttcaaaaattagaaatgtt

SEQ ID NO: 437498 - DNA, 1972 bp, Homo sapiens
ttagcgctctaggtacgaggccccggctgtttacggacggcgcccgcctcgattttcccaggcgagggcacgcccgcgtcagtcgcctccggggcaccttcctcgccacgacacgcaggtaaccgggccccgggagccggtcggcggcggcggactgggaccttgatcctgcctgcccggccgcccgacaagggaatgagagcggaccccgaactccacacacccgcgtttagccgccacacctaaggggcagaacagtctttttgggtaagggccgggctgggggcgacgcgccccgcccgctttgcagacttcggggtgctctgcacgacgcctgaaaggccgcggggcccgcatttctctgtgctgccctcctggagaaccgggacacggggacgggagggccagcatcggctacggcccggtttcccgtttctttcctctgtcgcgtctgggccctcctgcagcgtccatgatgaaggccaggggctgttgctttcctctcgcccagtagccaacccaagcaagggaattaattatctgaagaaatggatacttctccctccagaaaatatccagttaaaaaacgggtgaaaatacatcccaacacagtgatggtgaaatatacttctcattatccccagcctggcgatgatggatatgaagaaatcaatgaaggctatgggaattttatggaggaaaatccaaagaaaggtctgctgagtgaaatgaaaaaaaaagggagagctttctttggaaccatggataccctacctccaccaacagaagacccaatgatcaatgagattggacaattccagagctttgcagaaaaaaacatttttcaatcccgaaaaatgtggatagtgctgtttggatctgctttggctcatggatgtgtagctcttatcactaggcttgtttctgatcggtctaaagttccatctctagaactgatttttatccgttctgtttttcaggtcttatctgtgttagttgtgtgttactatcaggaggccccctttggacccagtggatacagattacgactcttcttttatggtgtatgcaatgtcatttctatcacttgtgcttatacatcattttcaatagttcctcccagcaatgggaccactatgtggagagccacaactacagtcttcagtgccattttggcttttttactcgtagatgagaaaatggcttatgttgacatggctacagttgtttgcagcatcttaggtgtttgtcttgtcatgatcccaaacattgttgatgaagacaattctttgttaaatgcctggaaagaagcctttgggtacaccatgactgtgatggctggactgaccactgctctctcaatgatagtatacagatccatcaaggagaagatcagcatgtggactgcactgtttacttttggttggactgggacaatttggggaatatctactatgtttattcttcaagaacccatcatcccattagatggagaaacctggagttatctcattgctatatgtgtctgttctactgcagcattcttaggagtttattatgccttggacaaattccatccagctttggttagcacagtacaacatttggagattgtggtagctatggtcttgcagcttctcgtgctgcacatatttcctagcatctatgatgtttttggaggggtaatcattatgattagtgtttttgtccttgctggctataaactttactggaggaatttaagaaggcaggactaccaggaaatactagactctcccattaaatgaatacctgattattattgtctcattaatgttcagttattaatatgtatactgccattttaatgtttacctatgaatgtcttttgtgttatataactgacagagtgctataaaatatataatatatacaaatgcagaaaatttattctagtctaatatattcaaatacaaatattaaatatatgaaa

SEQ ID NO: 437499 - DNA, 1560 bp, Homo sapiens
ttagcgctctaggtacgaggccccggctgtttacggacggcgcccgcctcgattttcccaggcgagggcacgcccgcgtcagtcgcctccggggcaccttcctcgccacgacacgcagaattaattatctgaagaaatggatacttctccctccagaaaatatccagttaaaaaacgggtgaaaatacatcccaacacagtgatggtgaaatatacttctcattatccccagcctggcgatgatggatatgaagaaatcaatgaaggctatgggaattttatggaggaaaatccaaagaaaggtctgctgagtgaaatgaaaaaaaaagggagagctttctttggaaccatggataccctacctccaccaacagaagacccaatgatcaatgagattggacaattccagagctttgcagaaaaaaacatttttcaatcccgaaaaatgtggatagtgctgtttggatctgctttggctcatggatgtgtagctcttatcactaggcttgtttctgatcggtctaaagttccatctctagaactgatttttatccgttctgtttttcaggtcttatctgtgttagttgtgtgttactatcaggaggccccctttggacccagtggatacagattacgactcttcttttatggtgtatgcaatgtcatttctatcacttgtgcttatacatcattttcaatagttcctcccagcaatgggaccactatgtggagagccacaactacagtcttcagtgccattttggcttttttactcgtagatgagaaaatggcttatgttgacatggctacagttgtttgcagcatcttaggtgtttgtcttgtcatgatcccaaacattgttgatgaagacaattctttgttaaatgcctggaaagaagcctttgggtacaccatgactgtgatggctggactgaccactgctctctcaatgatagtatacagatccatcaaggagaagatcagcatgtggactgcactgtttacttttggttggactgggacaatttggggaatatctactatgtttattcttcaagaacccatcatcccattagatggagaaacctggagttatctcattgctatatgtgtctgttctactgcagcattcttaggagtttattatgccttggacaaattccatccagctttggttagcacagtacaacatttggagattgtggtagctatggtcttgcagcttctcgtgctgcacatatttcctagcatctatgatgtttttggaggggtaatcattatgattagtgtttttgtccttgctggctataaactttactggaggaatttaagaaggcaggactaccaggaaatactagactctcccattaaatgaatacctgattattattgtctcattaatgttcagttattaatatgtatactgccattttaatgtttacctatgaatgtcttttgtgttatataactgacagagtgctataaaatatataatatatacaaatgcagaaaatttattctagtctaatatattcaaatacaaatattaaatatatgaaa

SEQ ID NO: 437500 - DNA, 1568 bp, Homo sapiens
agatggagttttgcttttgttgcccaggctggagtgcaatggcatgatctgggctcactgcaacctccgcctcctggggtgcaagcgattctcatgcctctgcctcctgagtagctgggattacagaattaattatctgaagaaatggatacttctccctccagaaaatatccagttaaaaaacgggtgaaaatacatcccaacacagtgatggtgaaatatacttctcattatccccagcctggcgatgatggatatgaagaaatcaatgaaggctatgggaattttatggaggaaaatccaaagaaaggtctgctgagtgaaatgaaaaaaaaagggagagctttctttggaaccatggataccctacctccaccaacagaagacccaatgatcaatgagattggacaattccagagctttgcagaaaaaaacatttttcaatcccgaaaaatgtggatagtgctgtttggatctgctttggctcatggatgtgtagctcttatcactaggcttgtttctgatcggtctaaagttccatctctagaactgatttttatccgttctgtttttcaggtcttatctgtgttagttgtgtgttactatcaggaggccccctttggacccagtggatacagattacgactcttcttttatggtgtatgcaatgtcatttctatcacttgtgcttatacatcattttcaatagttcctcccagcaatgggaccactatgtggagagccacaactacagtcttcagtgccattttggcttttttactcgtagatgagaaaatggcttatgttgacatggctacagttgtttgcagcatcttaggtgtttgtcttgtcatgatcccaaacattgttgatgaagacaattctttgttaaatgcctggaaagaagcctttgggtacaccatgactgtgatggctggactgaccactgctctctcaatgatagtatacagatccatcaaggagaagatcagcatgtggactgcactgtttacttttggttggactgggacaatttggggaatatctactatgtttattcttcaagaacccatcatcccattagatggagaaacctggagttatctcattgctatatgtgtctgttctactgcagcattcttaggagtttattatgccttggacaaattccatccagctttggttagcacagtacaacatttggagattgtggtagctatggtcttgcagcttctcgtgctgcacatatttcctagcatctatgatgtttttggaggggtaatcattatgattagtgtttttgtccttgctggctataaactttactggaggaatttaagaaggcaggactaccaggaaatactagactctcccattaaatgaatacctgattattattgtctcattaatgttcagttattaatatgtatactgccattttaatgtttacctatgaatgtcttttgtgttatataactgacagagtgctataaaatatataatatatacaaatgcagaaaatttattctagtctaatatattcaaatacaaatattaaatatatgaaa

SEQ ID NO: 437501 - DNA, 1709 bp, Homo sapiens
ttagcgctctaggtacgaggccccggctgtttacggacggcgcccgcctcgattttcccaggcgagggcacgcccgcgtcagtcgcctccggggcaccttcctcgccacgacacgcaggtaaccgggccccgggagccggtcggcggcggcggactgggaccttgatcctgcctgcccggccgcccgacaagggaatgagagcggaccccgaactccacacacccgcgtttagccgccacacctaaggggcagaacagtctttttggaattaattatctgaagaaatggatacttctccctccagaaaatatccagttaaaaaacgggtgaaaatacatcccaacacagtgatggtgaaatatacttctcattatccccagcctggcgatgatggatatgaagaaatcaatgaaggctatgggaattttatggaggaaaatccaaagaaaggtctgctgagtgaaatgaaaaaaaaagggagagctttctttggaaccatggataccctacctccaccaacagaagacccaatgatcaatgagattggacaattccagagctttgcagaaaaaaacatttttcaatcccgaaaaatgtggatagtgctgtttggatctgctttggctcatggatgtgtagctcttatcactaggcttgtttctgatcggtctaaagttccatctctagaactgatttttatccgttctgtttttcaggtcttatctgtgttagttgtgtgttactatcaggaggccccctttggacccagtggatacagattacgactcttcttttatggtgtatgcaatgtcatttctatcacttgtgcttatacatcattttcaatagttcctcccagcaatgggaccactatgtggagagccacaactacagtcttcagtgccattttggcttttttactcgtagatgagaaaatggcttatgttgacatggctacagttgtttgcagcatcttaggtgtttgtcttgtcatgatcccaaacattgttgatgaagacaattctttgttaaatgcctggaaagaagcctttgggtacaccatgactgtgatggctggactgaccactgctctctcaatgatagtatacagatccatcaaggagaagatcagcatgtggactgcactgtttacttttggttggactgggacaatttggggaatatctactatgtttattcttcaagaacccatcatcccattagatggagaaacctggagttatctcattgctatatgtgtctgttctactgcagcattcttaggagtttattatgccttggacaaattccatccagctttggttagcacagtacaacatttggagattgtggtagctatggtcttgcagcttctcgtgctgcacatatttcctagcatctatgatgtttttggaggggtaatcattatgattagtgtttttgtccttgctggctataaactttactggaggaatttaagaaggcaggactaccaggaaatactagactctcccattaaatgaatacctgattattattgtctcattaatgttcagttattaatatgtatactgccattttaatgtttacctatgaatgtcttttgtgttatataactgacagagtgctataaaatatataatatatacaaatgcagaaaatttattctagtctaatatattcaaatacaaatattaaatatatgaaa

SEQ ID NO: 437502 - DNA, 1918 bp, Homo sapiens
tcagtgtatttttatatctcaaaacttatggggagtccagaataaatgtttaaaaatcactataatttataaggtgaattctggtattatacagaattgattatacaaaatactttggacttaactaataatttataacaggcaaatggacccaatgagaaggaaaggtttgacctaagttattatttatctttctgtgttttgcttgttggataggtggagaaacaggtaggaatgaaaagatggaaaaatccgtttgtggtataaagatagaagatagagctgaattaaacaagtaagcaaagagaaatggagacagacttcagatgagagtgaaaaaagggtaaacaattccagtaggtaccatacatctgataaggcatattgccagatcatctctaatttcttttttttctggactactgttacagcctctactttctatcattgaattgatgcatatgattataatagaaattaaattttcaatgaaatgaatgtctttttgtcaatttttttctttaaatagaaaattaattatctgaagaaatggatacttctccctccagaaaatatccagttaaaaaacgggtgaaaatacatcccaacacagtgatggtgaaatatacttctcattatccccagcctggcgatgatggatatgaagaaatcaatgaaggctatgggaattttatggaggaaaatccaaagaaaggtctgctgagtgaaatgaaaacccaatgatcaatgagattggacaattccagagctttgcagaaaaaaacatttttcaatcccgaaaaatgtggatagtgctgtttggatctgctttggctcatggatgtgtagctcttatcactaggcttgtttctgatcggtctaaagttccatctctagaactgatttttatccgttctgtttttcaggtcttatctgtgttagttgtgtgttactatcaggaggccccctttggacccagtggatacagattacgactcttcttttatggtgtatgcaatgtcatttctatcacttgtgcttatacatcattttcaatagttcctcccagcaatgggaccactatgtggagagccacaactacagtcttcagtgccattttggcttttttactcgtagatgagaaaatggcttatgttgacatggctacagttgtttgcagcatcttaggtgtttgtcttgtcatgatcccaaacattgttgatgaagacaattctttgttaaatgcctggaaagaagcctttgggtacaccatgactgtgatggctggactgaccactgctctctcaatgatagtatacagatccatcaaggagaagatcagcatgtggactgcactgtttacttttggttggactgggacaatttggggaatatctactatgtttattcttcaagaacccatcatcccattagatggagaaacctggagttatctcattgctatatgtgtctgttctactgcagcattcttaggagtttattatgccttggacaaattccatccagctttggttagcacagtacaacatttggagattgtggtagctatggtcttgcagcttctcgtgctgcacatatttcctagcatctatgatgtttttggaggggtaatcattatgattagtgtttttgtccttgctggctataaactttactggaggaatttaagaaggcaggactaccaggaaatactagactctcccattaaatgaatacctgattattattgtctcattaatgttcagttattaatatgtatactgccattttaatgtttacctatgaatgtcttttgtgttatataactgacagagtgctataaaatatataatatatacaaatgcagaaaatttattctagtctaatatattcaaatacaaatattaaatatatgaaa

SEQ ID NO: 437503 - DNA, 1578 bp, Homo sapiens
agcggaggcgcagagtccgcgcggcggcgcccctctccctccgcagtactccggacggcgcccgcctcgattttcccaggcgagggcacgcccgcgtcagtcgcctccggggcaccttcctcgccacgacacgcagaattaattatctgaagaaatggatacttctccctccagaaaatatccagttaaaaaacgggtgaaaatacatcccaacacagtgatggtgaaatatacttctcattatccccagcctggcgatgatggatatgaagaaatcaatgaaggctatgggaattttatggaggaaaatccaaagaaaggtctgctgagtgaaatgaaaaaaaaagggagagctttctttggaaccatggataccctacctccaccaacagaagacccaatgatcaatgagattggacaattccagagctttgcagaaaaaaacatttttcaatcccgaaaaatgtggatagtgctgtttggatctgctttggctcatggatgtgtagctcttatcactaggcttgtttctgatcggtctaaagttccatctctagaactgatttttatccgttctgtttttcaggtcttatctgtgttagttgtgtgttactatcaggaggccccctttggacccagtggatacagattacgactcttcttttatggtgtatgcaatgtcatttctatcacttgtgcttatacatcattttcaatagttcctcccagcaatgggaccactatgtggagagccacaactacagtcttcagtgccattttggcttttttactcgtagatgagaaaatggcttatgttgacatggctacagttgtttgcagcatcttaggtgtttgtcttgtcatgatcccaaacattgttgatgaagacaattctttgttaaatgcctggaaagaagcctttgggtacaccatgactgtgatggctggactgaccactgctctctcaatgatagtatacagatccatcaaggagaagatcagcatgtggactgcactgtttacttttggttggactgggacaatttggggaatatctactatgtttattcttcaagaacccatcatcccattagatggagaaacctggagttatctcattgctatatgtgtctgttctactgcagcattcttaggagtttattatgccttggacaaattccatccagctttggttagcacagtacaacatttggagattgtggtagctatggtcttgcagcttctcgtgctgcacatatttcctagcatctatgatgtttttggaggggtaatcattatgattagtgtttttgtccttgctggctataaactttactggaggaatttaagaaggcaggactaccaggaaatactagactctcccattaaatgaatacctgattattattgtctcattaatgttcagttattaatatgtatactgccattttaatgtttacctatgaatgtcttttgtgttatataactgacagagtgctataaaatatataatatatacaaatgcagaaaatttattctagtctaatatattcaaatacaaatattaaatatatgaaa

SEQ ID NO: 437504 - DNA, 2127 bp, Homo sapiens
ttagcgctctaggtacgaggccccggctgtttacggacggcgcccgcctcgattttcccaggcgagggcacgcccgcgtcagtcgcctccggggcaccttcctcgccacgacacgcaggtaaccgggccccgggagccggtcggcggcggcggactgggaccttgatcctgcctgcccggccgcccgacaagggaatgagagcggaccccgaactccacacacccgcgtttagccgccacacctaaggggcagaacagtctttttgggtaagggccgggctgggggcgacgcgccccgcccgctttgcagacttcggggtgctctgcacgacgcctgaaaggccgcggggcccgcatttctctgtgctgccctcctggagaaccgggacacggggacgggagggccagcatcggctacggcccggtttcccgtttctttcctctgtcgcgtctgggccctcctgcagcgtccatgatgaaggccaggggctgttgctttcctctcgcccagtagccaacccaagcaagggaattaattatctgaagaaatggatacttctccctccagaaaatatccagttaaaaaacgggtgaaaatacatcccaacacagtgatggtgaaatatacttctcattatccccagcctggcgatgatggatatgaagaaatcaatgaaggctatgggaattttatggaggaaaatccaaagaaaggtctgctgagtgaaatgaaaaaaaaagggagagctttctttggaaccatggataccctacctccaccaacagaagacccaatgatcaatgagattggacaattccagagctttgcagaaaaaaacatttttcaatcccgaaaaatgtggatagtgctgtttggatctgctttggctcatggatgtgtagctcttatcactaggcttgtttctgatcggtctaaagttccatctctagaactgatttttatccgttctgtttttcaggtcttatctgtgttagttgtgtgttactatcaggaggccccctttggacccagtggatacagattacgactcttcttttatggtgtatgcaatgtcatttctatcacttgtgcttatacatcattttcaatagttcctcccagcaatgggaccactatgtggagagccacaactacagtcttcagtgccattttggcttttttactcgtagatgagaaaatggcttatgttgacatggctacagttgtttgcagcatcttaggtgtttgtcttgtcatgatcccaaacattgttgatgaagacaattctttgttaaatgcctggaaagaagcctttgggtacaccatgactgtgatggctggactgaccactgctctctcaatgatagtatacagatccatcaaggagaagatcagcatgtggactgcactgtttacttttggttggactgggacaatttggggaatatctactatgtttattcttcaagaacccatcatcccattagatggagaaacctggagttatctcattgctatatgtgtctgttctactgcagcattcttaggagtttattatgccttggacaaattccatccagctttggttagcacagtacaacatttggagattgtggtagctatggtcttgcagcttctcgtgctgcacatatttcctagcatctatgatgtttttggaggggtaatcattatgattagtgtttttgtccttgctggctataaactttactggaggaatttaagaaggcaggactaccaggaaatactagactctcccattaaatgaatacctgattattattgtctcattaatgttcagttattaatatgtatactgccattttaatgtttacctatgaatgtcttttgtgttatataactgacagagtgctataaaatatataatatatacaaatgcagaaaatttattctagtctaatatattcaaatacaaatattaaatatatgaaatacgttatgaatctggtatctttattggtatttatgggtgtctttccaggtaaattgtagtagaaggagaatgttaactgctattactaaataatagaagactcaaagaaatgacccctttcagatggaactgaagttcaaaaattagaaatgtt

SEQ ID NO: 437505 - DNA, 1973 bp, Homo sapiens
tcagtgtatttttatatctcaaaacttatggggagtccagaataaatgtttaaaaatcactataatttataaggtgaattctggtattatacagaattgattatacaaaatactttggacttaactaataatttataacaggcaaatggacccaatgagaaggaaaggtttgacctaagttattatttatctttctgtgttttgcttgttggataggtggagaaacaggtaggaatgaaaagatggaaaaatccgtttgtggtataaagatagaagatagagctgaattaaacaagtaagcaaagagaaatggagacagacttcagatgagagtgaaaaaagggtaaacaattccagtaggtaccatacatctgataaggcatattgccagatcatctctaatttcttttttttctggactactgttacagcctctactttctatcattgaattgatgcatatgattataatagaaattaaattttcaatgaaatgaatgtctttttgtcaatttttttctttaaatagaaaattaattatctgaagaaatggatacttctccctccagaaaatatccagttaaaaaacgggtgaaaatacatcccaacacagtgatggtgaaatatacttctcattatccccagcctggcgatgatggatatgaagaaatcaatgaaggctatgggaattttatggaggaaaatccaaagaaaggtctgctgagtgaaatgaaaaaaaaagggagagctttctttggaaccatggataccctacctccaccaacagaagacccaatgatcaatgagattggacaattccagagctttgcagaaaaaaacatttttcaatcccgaaaaatgtggatagtgctgtttggatctgctttggctcatggatgtgtagctcttatcactaggcttgtttctgatcggtctaaagttccatctctagaactgatttttatccgttctgtttttcaggtcttatctgtgttagttgtgtgttactatcaggaggccccctttggacccagtggatacagattacgactcttcttttatggtgtatgcaatgtcatttctatcacttgtgcttatacatcattttcaatagttcctcccagcaatgggaccactatgtggagagccacaactacagtcttcagtgccattttggcttttttactcgtagatgagaaaatggcttatgttgacatggctacagttgtttgcagcatcttaggtgtttgtcttgtcatgatcccaaacattgttgatgaagacaattctttgttaaatgcctggaaagaagcctttgggtacaccatgactgtgatggctggactgaccactgctctctcaatgatagtatacagatccatcaaggagaagatcagcatgtggactgcactgtttacttttggttggactgggacaatttggggaatatctactatgtttattcttcaagaacccatcatcccattagatggagaaacctggagttatctcattgctatatgtgtctgttctactgcagcattcttaggagtttattatgccttggacaaattccatccagctttggttagcacagtacaacatttggagattgtggtagctatggtcttgcagcttctcgtgctgcacatatttcctagcatctatgatgtttttggaggggtaatcattatgattagtgtttttgtccttgctggctataaactttactggaggaatttaagaaggcaggactaccaggaaatactagactctcccattaaatgaatacctgattattattgtctcattaatgttcagttattaatatgtatactgccattttaatgtttacctatgaatgtcttttgtgttatataactgacagagtgctataaaatatataatatatacaaatgcagaaaatttattctagtctaatatattcaaatacaaatattaaatatatgaaa

SEQ ID NO: 437506 - DNA, 1506 bp, Homo sapiens
agcgccgtccccgacgcccctcccccttcctcccctccccctacgttccacggtatcatacagaaattaattatctgaagaaatggatacttctccctccagaaaatatccagttaaaaaacgggtgaaaatacatcccaacacagtgatggtgaaatatacttctcattatccccagcctggcgatgatggatatgaagaaatcaatgaaggctatgggaattttatggaggaaaatccaaagaaaggtctgctgagtgaaatgaaaaaaaaagggagagctttctttggaaccatggataccctacctccaccaacagaagacccaatgatcaatgagattggacaattccagagctttgcagaaaaaaacatttttcaatcccgaaaaatgtggatagtgctgtttggatctgctttggctcatggatgtgtagctcttatcactaggcttgtttctgatcggtctaaagttccatctctagaactgatttttatccgttctgtttttcaggtcttatctgtgttagttgtgtgttactatcaggaggccccctttggacccagtggatacagattacgactcttcttttatggtgtatgcaatgtcatttctatcacttgtgcttatacatcattttcaatagttcctcccagcaatgggaccactatgtggagagccacaactacagtcttcagtgccattttggcttttttactcgtagatgagaaaatggcttatgttgacatggctacagttgtttgcagcatcttaggtgtttgtcttgtcatgatcccaaacattgttgatgaagacaattctttgttaaatgcctggaaagaagcctttgggtacaccatgactgtgatggctggactgaccactgctctctcaatgatagtatacagatccatcaaggagaagatcagcatgtggactgcactgtttacttttggttggactgggacaatttggggaatatctactatgtttattcttcaagaacccatcatcccattagatggagaaacctggagttatctcattgctatatgtgtctgttctactgcagcattcttaggagtttattatgccttggacaaattccatccagctttggttagcacagtacaacatttggagattgtggtagctatggtcttgcagcttctcgtgctgcacatatttcctagcatctatgatgtttttggaggggtaatcattatgattagtgtttttgtccttgctggctataaactttactggaggaatttaagaaggcaggactaccaggaaatactagactctcccattaaatgaatacctgattattattgtctcattaatgttcagttattaatatgtatactgccattttaatgtttacctatgaatgtcttttgtgttatataactgacagagtgctataaaatatataatatatacaaatgcagaaaatttattctagtctaatatattcaaatacaaatattaaatatatgaaa

SEQ ID NO: 437507 - DNA, 632 bp, Homo sapiens
aaaacagacaggccaagttcacaagcattgcatagccatgcaggtcagacatctagacggatccaccaacatgcgaactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggtcaggctggacgccatgttcctccgttcgcatgttaacatgcgaacggactgatccacaccctccacgttgagtccatcaccaagtcctgttgattctgcctctgaagtatcttcctcctctggctcttgcccacatgccagcccacagtgctggcataatggaccctcgtggcacttctgctcagtccccacagcgttgtcacagtgactatttaaaatcataaagcaggtcttgctttaatctccttgattctcgttgttcttagagtaagatctagaaattctcaacgtggcatctgtggatcagtccgttcgcatgtttatggctgaatcatccgctaccttcacgccaatggcgcctcaatattctttatctgcctcttcctacacatcgggcgagg

SEQ ID NO: 437508 - DNA, 2244 bp, Homo sapiens
tttaatgtaaagtaaaagctataaagcagtatttttttggccatttgtcaagaccggccccgccctccggagccggacgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggtcaggctggacgccatgttccgtgccttcaaatctcttgacaaagatggcactggacaaatccaggtgaacatccaggagtggctgcagctgactatgtattcctgaactggagccccagacccgccccctcaccgccttgctataggagtcacctggagcctcggtctctcccagggccgatcctgtctgcagtcacatctttgtggggcctgctgacccacaagcttttgttctctcagtacttgttacccagcttctcaacatccagggcccaatttgccctgcctggagttccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctctaaaaaaaaaaaaaaaaaaaaaaaaaaaaggggggggcggccaaaaattctccctctgggggggccccaatttttacgcggtcccccgggttttttggttccaagggggccccttattgggggcgggtttaaatagacccatgggcagcgggccccgcccgctgtataaccaccgcggtcggtggacctgtggggcaaacgcgtgcctatagcccttgggggcagccttgtgtggtgcaggcgacccctttactttcgtggcgcgtgccgccaccattacgtgcggccaaaacttacccttacccagagaatttaaacgcccctaagggggaaaacttttagaacatttaaccgtgcgtctctccgtggctgttcaccccataccgccgtgcaaatatgtggccctggggccggaccgtgggaagaaaattttggtgcggctcaacccggcagatatacgggattttaggtgaacaacctttttttttcccgcggggctcctctgttttataataatggggcagcgactgacatccatagacacatgcagcatcaacaacgaccacctgaacgccaaaacaatacctgccacagaaccatgctacgatcatcacaccggcgggactgaaccaccaccgaggccagccatcaatcatcaatcgacgcgagcacgaggcacgcacgatcatgcgcgactaccgcgacgagattcactacgcatgaccacagcagacgatagcacccaatcgagatccgacctccgacacgact

SEQ ID NO: 437509 - DNA, 2023 bp, Homo sapiens
tttaatgtaaagtaaaagctataaagcagtatttttttggccatttgtcaagaccggccccgccctccggagccggacgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggtcaggctggacgccatgttccgtgccttcaaatctcttgacaaagatggcactggacaaatccaggtgaacatccaggagtggctgcagctgactatgtattcctgaactggagccccagacccgccccctcaccgccttgctataggagtcacctggagcctcggtctctcccagggccgatcctgtctgcagtcacatctttgtggggcctgctgacccacaagcttttgttctctcagtacttgttacccagcttctcaacatccagggcccaatttgccctgcctggagttccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctctaaaaaacgagaaacaaaaacaaaagacaaacgacacaaaaatttttgggtgaggcgagacattacgaccccgagaaaaaggttatttaaaacacacactatcgttatggggcgcggcgggaccccacatgatagagtcataaggtcacacacaggagcgaccataagagacggagctaaccccaaagagagaacaccccacgggacaaaagacaacaggcgggttgtgggtattccatcacaccgaatataaaaaaagcgcgcgcggtgggacaacccgagagctgttggtgaacaacaactcccaagatggggaaccaacgagagggccgaaaggggagtcacaacacaggggagccacaagagagagctctagaatacaaatatccccggacgcgggtgacagacgagcaagaccaaacaacacaacatacgaaacagcaacgaaagctgtagacggacgcaagcgaaagagagaagacaaagaacagacacgaacaagccagaaaagcacacagagaacgaacagagcaacgaacacaaagacacg

SEQ ID NO: 437510 - DNA, 2164 bp, Homo sapiens
  misc_feature (23)..(23): n is a, c, g, or t
  misc_feature (29)..(29): n is a, c, g, or t
acttaggctagtacgaggccggntgttantcggccccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggtcaggctggacgccatgttccgtgccttcaaatctcttgacaaagatggcactggacaaatccaggtgaacatccaggagtggctgcagctgactatgtattcctgaactggagccccagacccgccccctcaccgccttgctataggagtcacctggagcctcggtctctcccagggccgatcctgtctgcagtcacatctttgtggggcctgctgacccacaagcttttgttctctcagtacttgttacccagcttctcaacatccagggcccaatttgccctgcctggagttccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctctaaaaaaaaaaaaaaaaaaaaaaaaaaaaggggggggcggccaaaaattctccctctgggggggccccaatttttacgcggtcccccgggttttttggttccaagggggccccttattgggggcgggtttaaatagacccatgggcagcgggccccgcccgctgtataaccaccgcggtcggtggacctgtggggcaaacgcgtgcctatagcccttgggggcagccttgtgtggtgcaggcgacccctttactttcgtggcgcgtgccgccaccattacgtgcggccaaaacttacccttacccagagaatttaaacgcccctaagggggaaaacttttagaacatttaaccgtgcgtctctccgtggctgttcaccccataccgccgtgcaaatatgtggccctggggccggaccgtgggaagaaaattttggtgcggctcaacccggcagatatacgggattttaggtgaacaacctttttttttcccgcggggctcctctgttttataataatggggcagcgactgacatccatagacacatgcagcatcaacaacgaccacctgaacgccaaaacaatacctgccacagaaccatgctacgatcatcacaccggcgggactgaaccaccaccgaggccagccatcaatcatcaatcgacgcgagcacgaggcacgcacgatcatgcgcgactaccgcgacgagattcactacgcatgaccacagcagacgatagcacccaatcgagatccgacctccgacacgact

SEQ ID NO: 437511 - DNA, 2190 bp, Homo sapiens
  misc_feature (23)..(23): n is a, c, g, or t
  misc_feature (29)..(29): n is a, c, g, or t
acttaggctagtacgaggccggntgttantcggccggtgtgggctcaggggcgaagcacccactggtccccttttttccccccagcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggtcaggctggacgccatgttccgtgccttcaaatctcttgacaaagatggcactggacaaatccaggtgaacatccaggagtggctgcagctgactatgtattcctgaactggagccccagacccgccccctcaccgccttgctataggagtcacctggagcctcggtctctcccagggccgatcctgtctgcagtcacatctttgtggggcctgctgacccacaagcttttgttctctcagtacttgttacccagcttctcaacatccagggcccaatttgccctgcctggagttccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctctaaaaaaaaaaaaaaaaaaaaaaaaaaaaggggggggcggccaaaaattctccctctgggggggccccaatttttacgcggtcccccgggttttttggttccaagggggccccttattgggggcgggtttaaatagacccatgggcagcgggccccgcccgctgtataaccaccgcggtcggtggacctgtggggcaaacgcgtgcctatagcccttgggggcagccttgtgtggtgcaggcgacccctttactttcgtggcgcgtgccgccaccattacgtgcggccaaaacttacccttacccagagaatttaaacgcccctaagggggaaaacttttagaacatttaaccgtgcgtctctccgtggctgttcaccccataccgccgtgcaaatatgtggccctggggccggaccgtgggaagaaaattttggtgcggctcaacccggcagatatacgggattttaggtgaacaacctttttttttcccgcggggctcctctgttttataataatggggcagcgactgacatccatagacacatgcagcatcaacaacgaccacctgaacgccaaaacaatacctgccacagaaccatgctacgatcatcacaccggcgggactgaaccaccaccgaggccagccatcaatcatcaatcgacgcgagcacgaggcacgcacgatcatgcgcgactaccgcgacgagattcactacgcatgaccacagcagacgatagcacccaatcgagatccgacctccgacacgact

SEQ ID NO: 437512 - DNA, 2588 bp, Homo sapiens
tttaatgtaaagtaaaagctataaagcagtatttttttggccatttgtcaagaccggccccgccctccggagccggacgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcaggtaaggcggagactatcagaggggcggggcctgggaatgggaggagcctcagtgaggcgtggtctgggaggggcgtggtctaaaaatagaataggattaacctggaggctaacctgggtacatgaattaggccggggaggcctggtttgagagttctgctgtaagggggtggaccccagtgaggcggatatcagtcattgggggcggtgcttgatatgggagtagtctgattgtgtgggaccaggacaatgtggtcctgaggggactgatgtggagttttggcgggtggggcttatgggtctgggctcagcctgcattggctaacctggagatgaacgttaaagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggtcaggctggacgccatgttccgtgccttcaaatctcttgacaaagatggcactggacaaatccaggtgaacatccaggagtggctgcagctgactatgtattcctgaactggagccccagacccgccccctcaccgccttgctataggagtcacctggagcctcggtctctcccagggccgatcctgtctgcagtcacatctttgtggggcctgctgacccacaagcttttgttctctcagtacttgttacccagcttctcaacatccagggcccaatttgccctgcctggagttccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctctaaaaaaaaaaaaaaaaaaaaaaaaaaaaggggggggcggccaaaaattctccctctgggggggccccaatttttacgcggtcccccgggttttttggttccaagggggccccttattgggggcgggtttaaatagacccatgggcagcgggccccgcccgctgtataaccaccgcggtcggtggacctgtggggcaaacgcgtgcctatagcccttgggggcagccttgtgtggtgcaggcgacccctttactttcgtggcgcgtgccgccaccattacgtgcggccaaaacttacccttacccagagaatttaaacgcccctaagggggaaaacttttagaacatttaaccgtgcgtctctccgtggctgttcaccccataccgccgtgcaaatatgtggccctggggccggaccgtgggaagaaaattttggtgcggctcaacccggcagatatacgggattttaggtgaacaacctttttttttcccgcggggctcctctgttttataataatggggcagcgactgacatccatagacacatgcagcatcaacaacgaccacctgaacgccaaaacaatacctgccacagaaccatgctacgatcatcacaccggcgggactgaaccaccaccgaggccagccatcaatcatcaatcgacgcgagcacgaggcacgcacgatcatgcgcgactaccgcgacgagattcactacgcatgaccacagcagacgatagcacccaatcgagatccgacctccgacacgact

SEQ ID NO: 437513 - DNA, 2274 bp, Homo sapiens
tttaatgtaaagtaaaagctataaagcagtatttttttggccatttgtcaagaccggccccgccctccggagccggacgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatctgtcactcttcttaacaccctcccaccagagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggtcaggctggacgccatgttccgtgccttcaaatctcttgacaaagatggcactggacaaatccaggtgaacatccaggagtggctgcagctgactatgtattcctgaactggagccccagacccgccccctcaccgccttgctataggagtcacctggagcctcggtctctcccagggccgatcctgtctgcagtcacatctttgtggggcctgctgacccacaagcttttgttctctcagtacttgttacccagcttctcaacatccagggcccaatttgccctgcctggagttccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctctaaaaaaaaaaaaaaaaaaaaaaaaaaaaggggggggcggccaaaaattctccctctgggggggccccaatttttacgcggtcccccgggttttttggttccaagggggccccttattgggggcgggtttaaatagacccatgggcagcgggccccgcccgctgtataaccaccgcggtcggtggacctgtggggcaaacgcgtgcctatagcccttgggggcagccttgtgtggtgcaggcgacccctttactttcgtggcgcgtgccgccaccattacgtgcggccaaaacttacccttacccagagaatttaaacgcccctaagggggaaaacttttagaacatttaaccgtgcgtctctccgtggctgttcaccccataccgccgtgcaaatatgtggccctggggccggaccgtgggaagaaaattttggtgcggctcaacccggcagatatacgggattttaggtgaacaacctttttttttcccgcggggctcctctgttttataataatggggcagcgactgacatccatagacacatgcagcatcaacaacgaccacctgaacgccaaaacaatacctgccacagaaccatgctacgatcatcacaccggcgggactgaaccaccaccgaggccagccatcaatcatcaatcgacgcgagcacgaggcacgcacgatcatgcgcgactaccgcgacgagattcactacgcatgaccacagcagacgatagcacccaatcgagatccgacctccgacacgact

SEQ ID NO: 437514 - DNA, 2220 bp, Homo sapiens
  misc_feature (23)..(23): n is a, c, g, or t
  misc_feature (29)..(29): n is a, c, g, or t
acttaggctagtacgaggccggntgttantcggccggtgtgggctcaggggcgaagcacccactggtccccttttttccccccagcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatctgtcactcttcttaacaccctcccaccagagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggtcaggctggacgccatgttccgtgccttcaaatctcttgacaaagatggcactggacaaatccaggtgaacatccaggagtggctgcagctgactatgtattcctgaactggagccccagacccgccccctcaccgccttgctataggagtcacctggagcctcggtctctcccagggccgatcctgtctgcagtcacatctttgtggggcctgctgacccacaagcttttgttctctcagtacttgttacccagcttctcaacatccagggcccaatttgccctgcctggagttccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctctaaaaaaaaaaaaaaaaaaaaaaaaaaaaggggggggcggccaaaaattctccctctgggggggccccaatttttacgcggtcccccgggttttttggttccaagggggccccttattgggggcgggtttaaatagacccatgggcagcgggccccgcccgctgtataaccaccgcggtcggtggacctgtggggcaaacgcgtgcctatagcccttgggggcagccttgtgtggtgcaggcgacccctttactttcgtggcgcgtgccgccaccattacgtgcggccaaaacttacccttacccagagaatttaaacgcccctaagggggaaaacttttagaacatttaaccgtgcgtctctccgtggctgttcaccccataccgccgtgcaaatatgtggccctggggccggaccgtgggaagaaaattttggtgcggctcaacccggcagatatacgggattttaggtgaacaacctttttttttcccgcggggctcctctgttttataataatggggcagcgactgacatccatagacacatgcagcatcaacaacgaccacctgaacgccaaaacaatacctgccacagaaccatgctacgatcatcacaccggcgggactgaaccaccaccgaggccagccatcaatcatcaatcgacgcgagcacgaggcacgcacgatcatgcgcgactaccgcgacgagattcactacgcatgaccacagcagacgatagcacccaatcgagatccgacctccgacacgact

SEQ ID NO: 437515 - DNA, 2420 bp, Homo sapiens
tttaatgtaaagtaaaagctataaagcagtatttttttggccatttgtcaagaccggccccgccctccggagccggacgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggtcaggctggacgccatgttccgtgccttcaaatctcttgacaaagatggcactggacaaatccaggtgaacatccaggaggtaaggacccccatattggggtatgggtgcctgggaggaccccacccctcagcccttcataccagctctgagctgcagtccccttcctcctattttgccagccgtccctgggtgagggcaaaggggctggtgctcttggggttccctgtcctcactctccaccctcctctccccagtggctgcagctgactatgtattcctgaactggagccccagacccgccccctcaccgccttgctataggagtcacctggagcctcggtctctcccagggccgatcctgtctgcagtcacatctttgtggggcctgctgacccacaagcttttgttctctcagtacttgttacccagcttctcaacatccagggcccaatttgccctgcctggagttccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctctaaaaaaaaaaaaaaaaaaaaaaaaaaaaggggggggcggccaaaaattctccctctgggggggccccaatttttacgcggtcccccgggttttttggttccaagggggccccttattgggggcgggtttaaatagacccatgggcagcgggccccgcccgctgtataaccaccgcggtcggtggacctgtggggcaaacgcgtgcctatagcccttgggggcagccttgtgtggtgcaggcgacccctttactttcgtggcgcgtgccgccaccattacgtgcggccaaaacttacccttacccagagaatttaaacgcccctaagggggaaaacttttagaacatttaaccgtgcgtctctccgtggctgttcaccccataccgccgtgcaaatatgtggccctggggccggaccgtgggaagaaaattttggtgcggctcaacccggcagatatacgggattttaggtgaacaacctttttttttcccgcggggctcctctgttttataataatggggcagcgactgacatccatagacacatgcagcatcaacaacgaccacctgaacgccaaaacaatacctgccacagaaccatgctacgatcatcacaccggcgggactgaaccaccaccgaggccagccatcaatcatcaatcgacgcgagcacgaggcacgcacgatcatgcgcgactaccgcgacgagattcactacgcatgaccacagcagacgatagcacccaatcgagatccgacctccgacacgact

SEQ ID NO: 437516 - DNA, 1620 bp, Homo sapiens
aaaacagacaggccaagttcacaagcattgcatagccatgcaggtcagacatctagacggatccaccaacatgcgaactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggtcaggctggacgccatgttccgtgccttcaaatctcttgacaaagatggcactggacaaatccaggtgaacatccaggagtggctgcagctgactatgtattcctgaactggagccccagacccgccccctcaccgccttgctataggagtcacctggagcctcggtctctcccagggccgatcctgtctgcagtcacatctttgtggggcctgctgacccacaagcttttgttctctcagtacttgttacccagcttctcaacatccagggcccaatttgccctgcctggagttccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctctaaaaaaaaaaaaaaaaaaaaaaaaaaaaggggggggcggccaaaaattctccctctgggggggccccaatttttacgcggtcccccgggttttttggttccaagggggccccttattgggggcgggtttaaatagacccatgggcagcgggccccgcccgctgtataaccaccgcggtcggtggacctgtggggcaaacgcgtgcctatagcccttgggggcagccttgtgtggtgcaggcgacccctttactttcgtggcgcgtgccgccaccattacgtgcggccaaaacttacccttacccagagaatttaaacgcccctaagggggaaaacttttagaacatttaaccgtgcgtctctccgtggctgttcaccccataccgccgtgcaaatatgtggccctggggccggaccgtgggaagaaaattttggtgcggctcaacccggcagatatacgggattttaggtgaacaacctttttttttcccgcggggctcctctgttttataataatggggcagcgactgacatccatagacacatgcagcatcaacaacgaccacctgaacgccaaaacaatacctgccacagaaccatgctacgatcatcacaccggcgggactgaaccaccaccgaggccagccatcaatcatcaatcgacgcgagcacgaggcacgcacgatcatgcgcgactaccgcgacgagattcactacgcatgaccacagcagacgatagcacccaatcgagatccgacctccgacacgact

SEQ ID NO: 437517 - DNA, 2130 bp, Homo sapiens
tttaatgtaaagtaaaagctataaagcagtatttttttggccatttgtcaagaccggccccgccctccggagccggacgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggtcaggctggacgccatgttccgtgccttcaaatctcttgacaaagatggcactggacaaatccaggtgaacatccaggagtggctgcagctgactatgtattcctgaactggagccccagacccgccccctcaccgccttgctataggagtcacctggagcctcggtctctcccagggccgatcctgtctgcagtcacatctttgtggggcctgctgacccacaagcttttgttctctcagtacttgtcacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctctaaaaaaaaaaaaaaaaaaaaaaaaaaaaggggggggcggccaaaaattctccctctgggggggccccaatttttacgcggtcccccgggttttttggttccaagggggccccttattgggggcgggtttaaatagacccatgggcagcgggccccgcccgctgtataaccaccgcggtcggtggacctgtggggcaaacgcgtgcctatagcccttgggggcagccttgtgtggtgcaggcgacccctttactttcgtggcgcgtgccgccaccattacgtgcggccaaaacttacccttacccagagaatttaaacgcccctaagggggaaaacttttagaacatttaaccgtgcgtctctccgtggctgttcaccccataccgccgtgcaaatatgtggccctggggccggaccgtgggaagaaaattttggtgcggctcaacccggcagatatacgggattttaggtgaacaacctttttttttcccgcggggctcctctgttttataataatggggcagcgactgacatccatagacacatgcagcatcaacaacgaccacctgaacgccaaaacaatacctgccacagaaccatgctacgatcatcacaccggcgggactgaaccaccaccgaggccagccatcaatcatcaatcgacgcgagcacgaggcacgcacgatcatgcgcgactaccgcgacgagattcactacgcatgaccacagcagacgatagcacccaatcgagatccgacctccgacacgact

SEQ ID NO: 437518 - DNA, 2046 bp, Homo sapiens
tttaatgtaaagtaaaagctataaagcagtatttttttggccatttgtcaagaccggccccgccctccggagccggacgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggtcaggctggacgccatgttccgtgccttcaaatctcttgacaaagatggcactggacaaatccaggtgaacatccaggagtggctgcagctgactatgtattcctgaactggagccccagacccgccccctcaccgccttgctataggagtcacctggagcctcggtctctcccagggccgatcctgtctgcagtcacatctttgtggggcctgctgacccacaagcttttgttctctcagtacttgtttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctctaaaaaaaaaaaaaaaaaaaaaaaaaaaaggggggggcggccaaaaattctccctctgggggggccccaatttttacgcggtcccccgggttttttggttccaagggggccccttattgggggcgggtttaaatagacccatgggcagcgggccccgcccgctgtataaccaccgcggtcggtggacctgtggggcaaacgcgtgcctatagcccttgggggcagccttgtgtggtgcaggcgacccctttactttcgtggcgcgtgccgccaccattacgtgcggccaaaacttacccttacccagagaatttaaacgcccctaagggggaaaacttttagaacatttaaccgtgcgtctctccgtggctgttcaccccataccgccgtgcaaatatgtggccctggggccggaccgtgggaagaaaattttggtgcggctcaacccggcagatatacgggattttaggtgaacaacctttttttttcccgcggggctcctctgttttataataatggggcagcgactgacatccatagacacatgcagcatcaacaacgaccacctgaacgccaaaacaatacctgccacagaaccatgctacgatcatcacaccggcgggactgaaccaccaccgaggccagccatcaatcatcaatcgacgcgagcacgaggcacgcacgatcatgcgcgactaccgcgacgagattcactacgcatgaccacagcagacgatagcacccaatcgagatccgacctccgacacgact

SEQ ID NO: 437519 - DNA, 1946 bp, Homo sapiens
  misc_feature (999)..(999): n is a, c, g, or t
tttaatgtaaagtaaaagctataaagcagtatttttttggccatttgtcaagaccggccccgccctccggagccggacgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggtcaggctggacgccatgttcccttcaaatctcttgacaagatggcactggagcgaatcgacgagtgaatcagtcacctggatagtaggcttagcagcgtcgagcttagtttatttcctggaatgttggatgcccgctaagaaccnctgctcgctcgcgtctacctgccgttgtctaattgtggtgtaccataaaacctcggtctctcccagggccgatcctgtctgcagtcacatctttgtggggcctgctgacccacaagcttttgttctctcagtacttgttacccagcttctcaacatccagggcccaatttgccctgcctggagttccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctctaaaacacaaacacacaagacaaacctcagaggaatcaaatgcagaggcgcggagacaaggggtcatgaactgggccatgggccaaacaagtaccgagacccaagatactggaccccacggtgacaacaagcgaggcaccaaaagagaagcgcatacaatttacgaaaaagcccgggtaccctcgtaacatcacgcgcacagagacaagagtagaattcaccaaaaaacagagggttataacggatagccagaaaattcaaaaggggtcaaaaaaacacaaaaccaaaacagcgcagtagcaaaacaagaaacaaaaataaagacgataaaaaatctatattctaatcaatataccttaaaataacataaaaataaaaactatctactaaaaactatcggattcttcatctaatcacagataaactccacaaaccagc

SEQ ID NO: 437520 - DNA, 1831 bp, Homo sapiens
tttaatgtaaagtaaaagctataaagcagtatttttttggccatttgtcaagaccggccccgccctccggagccggacgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctcacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctctaaaaaaaaaaaaaaaaaaaaaaaaaaaaggggggggcggccaaaaattctccctctgggggggccccaatttttacgcggtcccccgggttttttggttccaagggggccccttattgggggcgggtttaaatagacccatgggcagcgggccccgcccgctgtataaccaccgcggtcggtggacctgtggggcaaacgcgtgcctatagcccttgggggcagccttgtgtggtgcaggcgacccctttactttcgtggcgcgtgccgccaccattacgtgcggccaaaacttacccttacccagagaatttaaacgcccctaagggggaaaacttttagaacatttaaccgtgcgtctctccgtggctgttcaccccataccgccgtgcaaatatgtggccctggggccggaccgtgggaagaaaattttggtgcggctcaacccggcagatatacgggattttaggtgaacaacctttttttttcccgcggggctcctctgttttataataatggggcagcgactgacatccatagacacatgcagcatcaacaacgaccacctgaacgccaaaacaatacctgccacagaaccatgctacgatcatcacaccggcgggactgaaccaccaccgaggccagccatcaatcatcaatcgacgcgagcacgaggcacgcacgatcatgcgcgactaccgcgacgagattcactacgcatgaccacagcagacgatagcacccaatcgagatccgacctccgacacgact

SEQ ID NO: 437521 - DNA, 1336 bp, Homo sapiens
tttaatgtaaagtaaaagctataaagcagtatttttttggccatttgtcaagaccggccccgccctccggagccggacgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttgcccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctctaaaaaaaaaaaaaaaaaaaaaaaaaaaaggggggggcggccaaaaattctccctctgggggggccccaatttttacgcggtcccccgggttttttggttccaagggggccccttattgggggcgggtttaaatagacccatgggcagcgggccccgcccgctgtataaccaccgcggtcggtggacctgtggggcaaacgcgtgcctatagcccttgggggcagccttgtgtggtgcaggcgacccctttactttcgtggcgcgtgccgccaccattacgtgcggccaaaacttacccttacccagagaatttaaacgcccctaagggggaaaacttttagaacatttaaccgtgcgtctctccgtggctgttcaccccataccgccgtgcaaatatgtggccctggggccggaccgtgggaagaaaattttggtgcggctcaacccggcagatatacgggattttaggtgaacaacctttttttttcccgcggggctcctctgttttataataatggggcagcgactgacatccatagacacatgcagcatcaacaacgaccacctgaacgccaaaacaatacctgccacagaaccatgctacgatcatcacaccggcgggactgaaccaccaccgaggccagccatcaatcatcaatcgacgcgagcacgaggcacgcacgatcatgcgcgactaccgcgacgagattcactacgcatgaccacagcagacgatagcacccaatcgagatccgacctccgacacgact

SEQ ID NO: 437522 - DNA, 842 bp, Homo sapiens
tttaatgtaaagtaaaagctataaagcagtatttttttggccatttgtcaagaccggccccgccctccggagccggacgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagttccacctgaatgagcagctgatgaagttgtcaaaatccatgttcccactttcatctgagtagcgtcggatgatcatgtataga

SEQ ID NO: 437523 - DNA, 730 bp, Homo sapiens
tttaatgtaaagtaaaagctataaagcagtatttttttggccatttgtcaagaccggccccgccctccggagccggacgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggcatatacaaacagttcgacactaatttctctcgaccaatggacgagctga

SEQ ID NO: 437524 - DNA, 954 bp, Homo sapiens
  misc_feature (19)..(19): n is a, c, g, or t
  misc_feature (27)..(27): n is a, c, g, or t
  misc_feature (30)..(30): n is a, c, g, or t
gactactactactaaattngcggccgntcngactacccagcttctcaacatccagggcccaatttgccctgcctggagttccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctctaaaaaacgagaaacaaaaacaaaagacaaacgacacaaaaatttttgggtgaggcgagacattacgaccccgagaaaaaggttatttaaaacacacactatcgttatggggcgcggcgggaccccacatgatagagtcataaggtcacacacaggagcgaccataagagacggagctaaccccaaagagagaacaccccacgggacaaaagacaacaggcgggttgtgggtattccatcacaccgaatataaaaaaagcgcgcgcggtgggacaacccgagagctgttggtgaacaacaactcccaagatggggaaccaacgagagggccgaaaggggagtcacaacacaggggagccacaagagagagctctagaatacaaatatccccggacgcgggtgacagacgagcaagaccaaacaacacaacatacgaaacagcaacgaaagctgtagacggacgcaagcgaaagagagaagacaaagaacagacacgaacaagccagaaaagcacacagagaacgaacagagcaacgaacacaaagacacg

SEQ ID NO: 437525 - DNA, 1555 bp, Homo sapiens
  misc_feature (1482)..(1482): n is a, c, g, or t
  misc_feature (1485)..(1485): n is a, c, g, or t
  misc_feature (1487)..(1487): n is a, c, g, or t
tttaatgtaaagtaaaagctataaagcagtatttttttggccatttgtcaagaccggccccgccctccggagccggacgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggtcaggctggacgccatgttccgtgccttcaaatctcttgacaaagatggcactggacaaatccaggtgaacatccaggagtggctgcagctgactatgtattcctgaactggagccccagacccgccccctcaccgccttgctataggagtcacctggagcctcggtctctcccagggccgatcctgtctgcagtcacatctttgtggggcctgctgacccacaagcttttgttctctcagtacttgttacccagcttctcaacatccagggcccaatttgccctgcctggagttccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctctaaaaacanaananaaaaacccgagaaaaacacgggcaaaaagacaaacagaagacaggtgcaccccttgcaagggaaacgg

SEQ ID NO: 437526 - DNA, 2169 bp, Homo sapiens
  misc_feature (20)..(20): n is a, c, g, or t
  misc_feature (25)..(25): n is a, c, g, or t
tggctaggtcgaggcctggntttanatcggcaccgaggctccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggtcaggctggacgccatgttccgtgccttcaaatctcttgacaaagatggcactggacaaatccaggtgaacatccaggagtggctgcagctgactatgtattcctgaactggagccccagacccgccccctcaccgccttgctataggagtcacctggagcctcggtctctcccagggccgatcctgtctgcagtcacatctttgtggggcctgctgacccacaagcttttgttctctcagtacttgttacccagcttctcaacatccagggcccaatttgccctgcctggagttccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctctaaaaaaaaaaaaaaaaaaaaaaaaaaaaggggggggcggccaaaaattctccctctgggggggccccaatttttacgcggtcccccgggttttttggttccaagggggccccttattgggggcgggtttaaatagacccatgggcagcgggccccgcccgctgtataaccaccgcggtcggtggacctgtggggcaaacgcgtgcctatagcccttgggggcagccttgtgtggtgcaggcgacccctttactttcgtggcgcgtgccgccaccattacgtgcggccaaaacttacccttacccagagaatttaaacgcccctaagggggaaaacttttagaacatttaaccgtgcgtctctccgtggctgttcaccccataccgccgtgcaaatatgtggccctggggccggaccgtgggaagaaaattttggtgcggctcaacccggcagatatacgggattttaggtgaacaacctttttttttcccgcggggctcctctgttttataataatggggcagcgactgacatccatagacacatgcagcatcaacaacgaccacctgaacgccaaaacaatacctgccacagaaccatgctacgatcatcacaccggcgggactgaaccaccaccgaggccagccatcaatcatcaatcgacgcgagcacgaggcacgcacgatcatgcgcgactaccgcgacgagattcactacgcatgaccacagcagacgatagcacccaatcgagatccgacctccgacacgact

SEQ ID NO: 437527 - DNA, 2156 bp, Homo sapiens
tttaatgtaaagtaaaagctataaagcagtatttttttggccatttgtcaagaccggccccgccctccggagccggacgctgcgggaggcccgggagcggcagtggaaccgactcccagaactccggacgtgtgcggcgcagtgagtcgcagccatgttcctggttaactcgttcttgaagggggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggtcaggctggacgccatgttccgtgccttcaaatctcttgacaaagatggcactggacaaatccaggtgaacatccaggagtggctgcagctgactatgtattcctgaactggagccccagacccgccccctcaccgccttgctataggagtcacctggagcctcggtctctcccagggccgatcctgtctgcagtcacatctttgtggggcctgctgacccacaagcttttgttctctcagtacttgttacccagcttctcaacatccagggcccaatttgccctgcctggagttccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctctaaaaaaaaaaaaaaaaaaaaaaaaaaaaggggggggcggccaaaaattctccctctgggggggccccaatttttacgcggtcccccgggttttttggttccaagggggccccttattgggggcgggtttaaatagacccatgggcagcgggccccgcccgctgtataaccaccgcggtcggtggacctgtggggcaaacgcgtgcctatagcccttgggggcagccttgtgtggtgcaggcgacccctttactttcgtggcgcgtgccgccaccattacgtgcggccaaaacttacccttacccagagaatttaaacgcccctaagggggaaaacttttagaacatttaaccgtgcgtctctccgtggctgttcaccccataccgccgtgcaaatatgtggccctggggccggaccgtgggaagaaaattttggtgcggctcaacccggcagatatacgggattttaggtgaacaacctttttttttcccgcggggctcctctgttttataataatggggcagcgactgacatccatagacacatgcagcatcaacaacgaccacctgaacgccaaaacaatacctgccacagaaccatgctacgatcatcacaccggcgggactgaaccaccaccgaggccagccatcaatcatcaatcgacgcgagcacgaggcacgcacgatcatgcgcgactaccgcgacgagattcactacgcatgaccacagcagacgatagcacccaatcgagatccgacctccgacacgact

SEQ ID NO: 437528 - DNA, 2154 bp, Homo sapiens
tttaatgtaaagtaaaagctataaagcagtatttttttggccatttgtcaagaccggccccgccctccggagccggacgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccggacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggtcaggctggacgccatgttccgtgccttcaaatctcttgacaaagatggcactggacaaatccaggtgaacatccaggagtggctgcagctgactatgtattcctgaactggagccccagacccgccccctcaccgccttgctataggagtcacctggagcctcggtctctcccagggccgatcctgtctgcagtcacatctttgtggggcctgctgacccacaagcttttgttctctcagtacttgttacccagcttctcaacatccagggcccaatttgccctgcctggagttccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctctaaaaaaaaaaaaaaaaaaaaaaaaaaaaggggggggcggccaaaaattctccctctgggggggccccaatttttacgcggtcccccgggttttttggttccaagggggccccttattgggggcgggtttaaatagacccatgggcagcgggccccgcccgctgtataaccaccgcggtcggtggacctgtggggcaaacgcgtgcctatagcccttgggggcagccttgtgtggtgcaggcgacccctttactttcgtggcgcgtgccgccaccattacgtgcggccaaaacttacccttacccagagaatttaaacgcccctaagggggaaaacttttagaacatttaaccgtgcgtctctccgtggctgttcaccccataccgccgtgcaaatatgtggccctggggccggaccgtgggaagaaaattttggtgcggctcaacccggcagatatacgggattttaggtgaacaacctttttttttcccgcggggctcctctgttttataataatggggcagcgactgacatccatagacacatgcagcatcaacaacgaccacctgaacgccaaaacaatacctgccacagaaccatgctacgatcatcacaccggcgggactgaaccaccaccgaggccagccatcaatcatcaatcgacgcgagcacgaggcacgcacgatcatgcgcgactaccgcgacgagattcactacgcatgaccacagcagacgatagcacccaatcgagatccgacctccgacacgact

SEQ ID NO: 437529 - DNA, 2186 bp, Homo sapiens
tttaatgtaaagtaaaagctataaagcagtatttttttggccatttgtcaagaccggccccgccctccggagccggacgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggtcaggctggacgccatgttccgtgccttcaaatctcttgacaaagatggcactggacaaatccaggtgaacatccaggagtggctgcagctgactatgtattcctgaactggagccccagacccgccccctcaccgccttgctataggagtcacctggagcctcggtctctcccagggccgatcctgtctgcagtcacatctttgtggggcctgctgacccacaagcttttgttctctcagtacttgttacccagcttctcaacatccagggcccaatttgccctgcctggagttccccctggctctaggacactctaacaagctctgtccacgggtctccccattcccaccaggccctgcacacacccactccgtaacctctcccctttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctctaaaaaaaaaaaaaaaaaaaaaaaaaaaaggggggggcggccaaaaattctccctctgggggggccccaatttttacgcggtcccccgggttttttggttccaagggggccccttattgggggcgggtttaaatagacccatgggcagcgggccccgcccgctgtataaccaccgcggtcggtggacctgtggggcaaacgcgtgcctatagcccttgggggcagccttgtgtggtgcaggcgacccctttactttcgtggcgcgtgccgccaccattacgtgcggccaaaacttacccttacccagagaatttaaacgcccctaagggggaaaacttttagaacatttaaccgtgcgtctctccgtggctgttcaccccataccgccgtgcaaatatgtggccctggggccggaccgtgggaagaaaattttggtgcggctcaacccggcagatatacgggattttaggtgaacaacctttttttttcccgcggggctcctctgttttataataatggggcagcgactgacatccatagacacatgcagcatcaacaacgaccacctgaacgccaaaacaatacctgccacagaaccatgctacgatcatcacaccggcgggactgaaccaccaccgaggccagccatcaatcatcaatcgacgcgagcacgaggcacgcacgatcatgcgcgactaccgcgacgagattcactacgcatgaccacagcagacgatagcacccaatcgagatccgacctccgacacgact

SEQ ID NO: 437530 - DNA, 1546 bp, Homo sapiens
aacggctagtacgaggccgtgtgaatcggccgaggctcccaggtgcctttgaggcagcagggttccacctgaatgagcatctctataacatgatcatccgacgctactcagatgaaagtgggaacatggattttgacaacttcatcagctgcttggtcaggctggacgccatgttccgtgccttcaaatctcttgacaaagatggcactggacaaatccaggtgaacatccaggagtggctgcagctgactatgtattcctgaactggagccccagacccgccccctcaccgccttgctataggagtcacctggagcctcggtctctcccagggccgatcctgtctgcagtcacatctttgtggggcctgctgacccacaagcttttgttctctcagtacttgttacccagcttctcaacatccagggcccaatttgccctgcctggagttccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctctaaaaaaaaaaaaaaaaaaaaaaaaaaaaggggggggcggccaaaaattctccctctgggggggccccaatttttacgcggtcccccgggttttttggttccaagggggccccttattgggggcgggtttaaatagacccatgggcagcgggccccgcccgctgtataaccaccgcggtcggtggacctgtggggcaaacgcgtgcctatagcccttgggggcagccttgtgtggtgcaggcgacccctttactttcgtggcgcgtgccgccaccattacgtgcggccaaaacttacccttacccagagaatttaaacgcccctaagggggaaaacttttagaacatttaaccgtgcgtctctccgtggctgttcaccccataccgccgtgcaaatatgtggccctggggccggaccgtgggaagaaaattttggtgcggctcaacccggcagatatacgggattttaggtgaacaacctttttttttcccgcggggctcctctgttttataataatggggcagcgactgacatccatagacacatgcagcatcaacaacgaccacctgaacgccaaaacaatacctgccacagaaccatgctacgatcatcacaccggcgggactgaaccaccaccgaggccagccatcaatcatcaatcgacgcgagcacgaggcacgcacgatcatgcgcgactaccgcgacgagattcactacgcatgaccacagcagacgatagcacccaatcgagatccgacctccgacacgact

SEQ ID NO: 437531 - DNA, 2199 bp, Homo sapiens
tttaatgtaaagtaaaagctataaagcagtatttttttggccatttgtcaagaccggccccgccctccggagccggacgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagactcagatgaaagtgggaacatggattttgacaacttcatcagctgcttggtcaggctggacgccatgttccgtgccttcaaatctcttgacaaagatggcactggacaaatccaggtgaacatccaggagtggctgcagctgactatgtattcctgaactggagccccagacccgccccctcaccgccttgctataggagtcacctggagcctcggtctctcccagggccgatcctgtctgcagtcacatctttgtggggcctgctgacccacaagcttttgttctctcagtacttgttacccagcttctcaacatccagggcccaatttgccctgcctggagttccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctctaaaaaaaaaaaaaaaaaaaaaaaaaaaaggggggggcggccaaaaattctccctctgggggggccccaatttttacgcggtcccccgggttttttggttccaagggggccccttattgggggcgggtttaaatagacccatgggcagcgggccccgcccgctgtataaccaccgcggtcggtggacctgtggggcaaacgcgtgcctatagcccttgggggcagccttgtgtggtgcaggcgacccctttactttcgtggcgcgtgccgccaccattacgtgcggccaaaacttacccttacccagagaatttaaacgcccctaagggggaaaacttttagaacatttaaccgtgcgtctctccgtggctgttcaccccataccgccgtgcaaatatgtggccctggggccggaccgtgggaagaaaattttggtgcggctcaacccggcagatatacgggattttaggtgaacaacctttttttttcccgcggggctcctctgttttataataatggggcagcgactgacatccatagacacatgcagcatcaacaacgaccacctgaacgccaaaacaatacctgccacagaaccatgctacgatcatcacaccggcgggactgaaccaccaccgaggccagccatcaatcatcaatcgacgcgagcacgaggcacgcacgatcatgcgcgactaccgcgacgagattcactacgcatgaccacagcagacgatagcacccaatcgagatccgacctccgacacgact

SEQ ID NO: 437532 - DNA, 2089 bp, Homo sapiens
tttaatgtaaagtaaaagctataaagcagtatttttttggccatttgtcaagaccggccccgccctccggagccggacgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggtcaggctggacgccatgttccgtgccttcaaatctcttgacaaagatggcactggacaaatccaggtgaacatccaggagtggctgcagctgactatgtattcctgaactggagccccagacccgccccctcaccgccttgcccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctctaaaaaaaaaaaaaaaaaaaaaaaaaaaaggggggggcggccaaaaattctccctctgggggggccccaatttttacgcggtcccccgggttttttggttccaagggggccccttattgggggcgggtttaaatagacccatgggcagcgggccccgcccgctgtataaccaccgcggtcggtggacctgtggggcaaacgcgtgcctatagcccttgggggcagccttgtgtggtgcaggcgacccctttactttcgtggcgcgtgccgccaccattacgtgcggccaaaacttacccttacccagagaatttaaacgcccctaagggggaaaacttttagaacatttaaccgtgcgtctctccgtggctgttcaccccataccgccgtgcaaatatgtggccctggggccggaccgtgggaagaaaattttggtgcggctcaacccggcagatatacgggattttaggtgaacaacctttttttttcccgcggggctcctctgttttataataatggggcagcgactgacatccatagacacatgcagcatcaacaacgaccacctgaacgccaaaacaatacctgccacagaaccatgctacgatcatcacaccggcgggactgaaccaccaccgaggccagccatcaatcatcaatcgacgcgagcacgaggcacgcacgatcatgcgcgactaccgcgacgagattcactacgcatgaccacagcagacgatagcacccaatcgagatccgacctccgacacgact

SEQ ID NO: 437533 - DNA, 1691 bp, Homo sapiens
tttaatgtaaagtaaaagctataaagcagtatttttttggccatttgtcaagaccggccccgccctccggagccggacgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggtcaggctggacgccatgttccctgccaggcccaggaggaaataaacatgccccagttgctgatctctaaaaaaaaaaaaaaaaaaaaaaaaaaaaggggggggcggccaaaaattctccctctgggggggccccaatttttacgcggtcccccgggttttttggttccaagggggccccttattgggggcgggtttaaatagacccatgggcagcgggccccgcccgctgtataaccaccgcggtcggtggacctgtggggcaaacgcgtgcctatagcccttgggggcagccttgtgtggtgcaggcgacccctttactttcgtggcgcgtgccgccaccattacgtgcggccaaaacttacccttacccagagaatttaaacgcccctaagggggaaaacttttagaacatttaaccgtgcgtctctccgtggctgttcaccccataccgccgtgcaaatatgtggccctggggccggaccgtgggaagaaaattttggtgcggctcaacccggcagatatacgggattttaggtgaacaacctttttttttcccgcggggctcctctgttttataataatggggcagcgactgacatccatagacacatgcagcatcaacaacgaccacctgaacgccaaaacaatacctgccacagaaccatgctacgatcatcacaccggcgggactgaaccaccaccgaggccagccatcaatcatcaatcgacgcgagcacgaggcacgcacgatcatgcgcgactaccgcgacgagattcactacgcatgaccacagcagacgatagcacccaatcgagatccgacctccgacacgact

SEQ ID NO: 437534 - DNA, 1526 bp, Homo sapiens
tttaatgtaaagtaaaagctataaagcagtatttttttggccatttgtcaagaccggccccgccctccggagccggacgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctctaaaaaaaaaaaaaaaaaaaaaaaaaaaaggggggggcggccaaaaattctccctctgggggggccccaatttttacgcggtcccccgggttttttggttccaagggggccccttattgggggcgggtttaaatagacccatgggcagcgggccccgcccgctgtataaccaccgcggtcggtggacctgtggggcaaacgcgtgcctatagcccttgggggcagccttgtgtggtgcaggcgacccctttactttcgtggcgcgtgccgccaccattacgtgcggccaaaacttacccttacccagagaatttaaacgcccctaagggggaaaacttttagaacatttaaccgtgcgtctctccgtggctgttcaccccataccgccgtgcaaatatgtggccctggggccggaccgtgggaagaaaattttggtgcggctcaacccggcagatatacgggattttaggtgaacaacctttttttttcccgcggggctcctctgttttataataatggggcagcgactgacatccatagacacatgcagcatcaacaacgaccacctgaacgccaaaacaatacctgccacagaaccatgctacgatcatcacaccggcgggactgaaccaccaccgaggccagccatcaatcatcaatcgacgcgagcacgaggcacgcacgatcatgcgcgactaccgcgacgagattcactacgcatgaccacagcagacgatagcacccaatcgagatccgacctccgacacgact

SEQ ID NO: 437535 - DNA, 1270 bp, Homo sapiens
tttaatgtaaagtaaaagctataaagcagtatttttttggccatttgtcaagaccggccccgccctccggagccggacgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttgcacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctctaaaaaaaaaaaaaaaaaaaaaaaaaaaaggggggggcggccaaaaattctccctctgggggggccccaatttttacgcggtcccccgggttttttggttccaagggggccccttattgggggcgggtttaaatagacccatgggcagcgggccccgcccgctgtataaccaccgcggtcggtggacctgtggggcaaacgcgtgcctatagcccttgggggcagccttgtgtggtgcaggcgacccctttactttcgtggcgcgtgccgccaccattacgtgcggccaaaacttacccttacccagagaatttaaacgcccctaagggggaaaacttttagaacatttaaccgtgcgtctctccgtggctgttcaccccataccgccgtgcaaatatgtggccctggggccggaccgtgggaagaaaattttggtgcggctcaacccggcagatatacgggattttaggtgaacaacctttttttttcccgcggggctcctctgttttataataatggggcagcgactgacatccatagacacatgcagcatcaacaacgaccacctgaacgccaaaacaatacctgccacagaaccatgctacgatcatcacaccggcgggactgaaccaccaccgaggccagccatcaatcatcaatcgacgcgagcacgaggcacgcacgatcatgcgcgactaccgcgacgagattcactacgcatgaccacagcagacgatagcacccaatcgagatccgacctccgacacgact

SEQ ID NO: 437536 - DNA, 601 bp, Homo sapiens
tttaatgtaaagtaaaagctataaagcagtatttttttggccatttgtcaagaccggccccgccctccggagccggacgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacagcctgatctgaaggctgatggttttggccctatcgaggggatcctaaggtgctca

SEQ ID NO: 437537 - DNA, 836 bp, Homo sapiens
tttgtaaatgaaaagggcttattttattttattcttatactaaattttagaaggtatttttataaagaccctgaattgtgttacctctctgataggtcttagatacttttttcctctggaagatttataaattaataatttgataggctataatttaaagtatgactttaagttcaaattggggcctgtgaaattttgagagtggagaatccatttgggtaaagagaaaacactcaaaatacatttgtgatttgtaaagttgtttacagaatgattcaaaaactgcgtctgggtactcagagatccaagtctaagttaaattgtctgtgatacccacggctgtgctgtctccttctttcagttcactccggggtcaggttagctgcatccttagcctttggcatggaatgtgctttgatgaacaaatgtctcatcaaacagccaaaatggtagaacttgcgtactttgaggtcagacaccatgtcttaaccataattaaaagatcatgaaacaataaaaagtaggtgacaagatcacctgctggattcacctcaattctttaaagttacttctttgagggcatgcagcttgcaaagcccatgctttaaaaatgcactgtgattttctcatcccccaccccctgtcttagctgtatccaaagaaaatttttatccttatttttgtctgtggagtgagattttcttttcaagtgcttgggagctttccatggtgtcctgtggatgcttcgaaatgaagccctctctttttaaatcctttccttttcttagacagaattgcctcttataatgtcttcttttttactctcaaaaaaaaaa

SEQ ID NO: 437538 - DNA, 250 bp, Homo sapiens
ctttgagggcatgcagcttgcaaagcccatgctttaaaaatgcactgtgattttctcatcccccaccccctgtcttagctgtatccaaagaaaatttttatccttatttttgtctgtggagtgagattttcttttcaagtgcttgggagctttccatggtgtcctgtggatgcttcgaaatgaagccctctctttttaaatcctttccttttcttagacagaattgcctcttataatgtcttctttttta

SEQ ID NO: 437539 - DNA, 296 bp, Homo sapiens
gacaattttgcagatgaaaaattgctgattcattgaagaaaaaaaatggtttgcatttgttatttatttttatgatttactttaatggacagtttgtaaatgaaaagggcttattttattttattcttatactaaattttagaaggtatttttataaagaccctgaattgtgttacctctctgataggtcttagatacttttttcctctggaagatttataaattaataatttgataggctataatttaaagtatgactttaagttcaaattggggcctgtgaaattttgagagtg

SEQ ID NO: 437540 - DNA, 2007 bp, Homo sapiens
gccatcgcgccattcctagttaaggcggcacagggccgaggcgtagtgtgggtgactcctccgttccttgggtcccgtcgtctgtgatactgcagcgcagccatggcagaaccgcagcccccgtccggcggcctcacggacgaggccgccctcagttgctgctccgacgcggaccccagtaccaaggattttctattgcagcagaccatgctacgagtgaaggatcctaagaagtcactggatttttatactagagttcttggaatgacgctaatccaaaaatgtgattttcccattatgaagttttcactctacttcttggcttatgaggataaaaatgacatccctaaagaaaaagatgaaaaaatagcctgggcgctctccagaaaagctacacttgagctgacacacaattggggcactgaagatgatgagacccagagttaccacaatggcaattcagaccctcgaggattcggtcatattggaattgctgttcctgatgtatacagtgcttgtaaaaggtttgaagaactgggagtcaaatttgtgaagaaacctgatgatggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagaaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataa

SEQ ID NO: 437541 - DNA, 806 bp, Homo sapiens
cggacgcgtgggtcgacccacgcgtcgcccacgcgtgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagaaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataa

SEQ ID NO: 437542 - DNA, 2055 bp, Homo sapiens
gccatcgcgccattcctagttaaggcggcacagggccgaggcgtagtgtgggtgactcctccgttccttgggtcccgtcgtctgtgatactgcagcgcagccatggcagaaccgcagcccccgtccggcggcctcacggacgaggccgccctcagttgctgctccgacgcggaccccagtaccaaggattttctattgcagcagaccatgctacgagtgaaggatcctaagaagtcactggatttttatactagagttcttggaatgacgctaatccaaaaatgtgattttcccattatgaagttttcactctacttcttggcttatgaggataaaaatgacatccctaaagaaaaagatgaaaaaatagcctgggcgctctccagaaaagctacacttgagctgacacacaattggggcactgaagatgatgagacccagagttaccacaatggcaattcagaccctcgaggattcggtcatattggaattgctgttcctgatgtatacagtgcttgtaaaaggtttgaagaactgggagtcaaatttgtgaagaaacctgatgatggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtcttgaataaagttacacaactatattcaaggacatgagataaagcactgcttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagaaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataa

SEQ ID NO: 437543 - DNA, 2612 bp, Homo sapiens
  misc_feature (2612)..(2612): n is a, c, g, or t
gccatcgcgccattcctagttaaggcggcacagggccgaggcgtagtgtgggtgactcctccgttccttgggtcccgtcgtctgtgatactgcagcgcagccatggcagaaccgcagcccccgtccggcggcctcacggacgaggccgccctcagttgctgctccgacgcggaccccagtaccaaggattttctattgcagcagaccatgctacgagtgaaggatcctaagaagtcactggatttttatactagagttcttggaatgacgctaatccaaaaatgtgattttcccattatgaagttttcactctacttcttggcttatgaggataaaaatgacatccctaaagaaaaagatgaaaaaatagcctgggcgctctccagaaaagctacacttgagctgacacacaattggggcactgaagatgatgagacccagagttaccacaatggcaattcagaccctcgaggattcggtcatattggaattgctgttcctgatgtatacagtgcttgtaaaaggtttgaagaactgggagtcaaatttgtgaagaaacctgatgatggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagaaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataaaaaaaaaaaaaaaaaaaaaaaaaaaaaaaaaaaagaggggggggcgcgccccaaaaattcccccgcggggggccccaatttcgcggttccccggttttttgtggttccaagggggccccctatataggaggagcgcgcgcgatttatatataaccgctagagggcgccactggggccgcgccgtttttaaaccaaacgccttcgtgagcctggggggagacaacccgtcgtgatcccgcttcggggacgactcttcggggagaaggagagccctttatacctccctggggcgggggcgacattatcttgggggaccaaattatcacactatcgccagagagaatatttttataagcgcgcccctaaagggcggcgacacctttttatcaaccacccttctctatcaacacgggcggtgtatctagcggggggtggtgtcacccaccccataaccgccgcgcgatatattattgccttaggcgcgcggttttgtgacaaacagcgcttttggcggcgccacacaccgggggagggctactagcgcattcttatggagacacacatttttttttatccccccgagggagcgcatgcgtagtacctan

SEQ ID NO: 437544 - DNA, 1938 bp, Homo sapiens
gccatcgcgccattcctagttaaggcggcacagggccgaggcgtagtgtgggtgactcctccgttccttgggtcccgtcgtctgtgatactgcagcgcagccatggcagaaccgcagcccccgtccggcggcctcacggacgaggccgccctcagttgctgctccgacgcggaccccagtaccaaggattttctattgcagcagaccatgctacgagtgaaggatcctaagaagtcactggatttttatactagagttcttggaatgacgctaatccaaaaatgtgattttcccattatgaagttttcactctacttcttggcttatgaggataaaaatgacatccctaaagaaaaagatgaaaaaatagcctgggcgctctccagaaaagctacacttgagctgacacacaattggggcactgaagatgatgagacccagagttaccacaatggcaattcagaccctcgaggattcggtcatattggaattgctgttcctgatgtatacagtgcttgtaaaaggtttgaagaactgggagtcaaatttgtgaagaaacctgatgatggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatagggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagaaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataa

SEQ ID NO: 437545 - DNA, 1994 bp, Homo sapiens
accacgcgtcgcggacgcgtgggtcgcggacgcgtgggcgcacagggccgaggcgtagtgtgggtgactcctccgttccttgggtcccgtcgtctgtgatactgcagcgcagccatggcagaaccgcagcccccgccctcagttgctgctccgacgcggaccccagtaccaaggattttctattgcagcagaccatgctacgagtgaaggatcctaagaagtcactggatttttatactagagttcttggaatgacgctaatccaaaaatgtgattttcccattatgaagttttcactctacttcttggcttatgaggataaaaatgacatccctaaagaaaaagatgaaaaaatagcctgggcgctctccagaaaagctacacttgagctgacacacaattggggcactgaagatgatgagacccagagttaccacaatggcaattcagaccctcgaggattcggtcatattggaattgctgttcctgatgtatacagtgcttgtaaaaggtttgaagaactgggagtcaaatttgtgaagaaacctgatgatggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagaaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataa

SEQ ID NO: 437546 - DNA, 1924 bp, Homo sapiens
gccatcgcgccattcctagttaaggcggcacagggccgaggcgtagtgtgggtgactcctccgttccttgggtcccgtcgtctgtgatactgcagcgcagccatggcagaaccgcagcccccgtccggcggcctcacggacgaggccgccctcagttgctgctccgacgcggaccccagtaccaaggctaatccaaaaatgtgattttcccattatgaagttttcactctacttcttggcttatgaggataaaaatgacatccctaaagaaaaagatgaaaaaatagcctgggcgctctccagaaaagctacacttgagctgacacacaattggggcactgaagatgatgagacccagagttaccacaatggcaattcagaccctcgaggattcggtcatattggaattgctgttcctgatgtatacagtgcttgtaaaaggtttgaagaactgggagtcaaatttgtgaagaaacctgatgatggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagaaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataa

SEQ ID NO: 437547 - DNA, 1662 bp, Homo sapiens
cggacgcgtgggtcgacccacgcgtcgcccacgcgtcgcagaaaagctacacttgagctgacacacaattggggcactgaagatgatgagacccagagttaccacaatggcaattcagaccctcgaggattcggtcatattggaattgctgttcctgatgtatacagtgcttgtaaaaggtttgaagaactgggagtcaaatttgtgaagaaacctgatgatggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagaaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataa

SEQ ID NO: 437548 - DNA, 1937 bp, Homo sapiens
ggcagtttcatcaatagaatggagatgttcacacctagcccatggagctgttttaagggtttaaatgaaatataaagtacttagcacaataaatgagcattattattattcttattattgttcttgtccagtacctgtatttactgtctctttagtctcgttaaaatcatactttggccatttgtcctttctatagttgaaaacttaatatttttgtagcaggggttaggccaattatgtaaagtagcatataaacgtggtaagatttcaaagatgttacttgcttttcagaatatctattccctaggacattgtagctatgttttccttccttttgtagcaattggggcactgaagatgatgagacccagagttaccacaatggcaattcagaccctcgaggattcggtcatattggaattgctgttcctgatgtatacagtgcttgtaaaaggtttgaagaactgggagtcaaatttgtgaagaaacctgatgatggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagaaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataa

SEQ ID NO: 437549 - DNA, 1953 bp, Homo sapiens
gccatcgcgccattcctagttaaggcggcacagggccgaggcgtagtgtgggtgactcctccgttccttgggtcccgtcgtctgtgatactgcagcgcagccatggcagaaccgcagcccccgtccggcggcctcacggacgaggccgccctcagttgctgctccgacgcggaccccagtaccaaggattttctattgcagcagaccatgctacgagtgaaggatcctaagaagtcactggatttttatactagagttcttggaatgacgctaatccaaaaatgtgattttcccattatgaagttttcactctacttcttggcttatgaggataaaaatgacatccctaaagaaaaagatgaaaaaatagcctgggcgctctccagaaaagctacacttgagctgacacacaattggggcactgaagatgatgagacccagagttaccacaatggcaattcagaccctcgaggattcggtcatattggaattgctgttcctgatgtatacagtgcttgtaaaaggtttgaagaactgggagtcaaatttgtgaagaaacctgatgatggtaaaatgaaaggcctggcatttattcaagatcctgatggctactggattgaaattttgaatcctaacaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagaaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataa

SEQ ID NO: 437550 - DNA, 1987 bp, Homo sapiens
gccatcgcgccattcctagttaaggcggcacagggccgaggcgtagtgtgggtgactcctccgttccttgggtcccgtcgtctgtgatactgcagcgcagccatggcagaaccgcagcccccgtccggcggcctcacggacgaggccgccctcagttgctgctccgacgcggaccccagtaccaaggattttctattgcagcagaccatgctacgagtgaaggatcctaagaagtcactggatttttatactagagttcttggaatgacgctaatccaaaaatgtgattttcccattatgaagttttcactctacttcttggcttatgaggataaaaatgacatccctaaagaaaaagatgaaaaaatagcctgggcgctctccagaaaagctacacttgagctgacacacaattggggcactgaagatgatgagacccagagttaccacaatggcaattcagaccctcgaggattcggtcatattggaattgctgttcctgatgtatacagtgcttgtaaaaggtttgaagaactgggagtcaaatttgtgaagaaacctgatgatggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgattttgaaaatctctaatggctcagaaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataa

SEQ ID NO: 437551 - DNA, 1589 bp, Homo sapiens
gcctgagacctgggaggaagctggagaaaagatgccctctgaatctttgtgtttggctgcccagccacgcaacacagctctaaacactggactctcatatccaccaacactcaatacctgtatatctgttttcaaccatttggagtcgaggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagaaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataa

SEQ ID NO: 437552 - DNA, 1761 bp, Homo sapiens
gtggtttgtgcttgtaatcccaccactttgggaggcaaggcaggaggattgcttgaggccaggagtttgatagcagcctgggcagtacattgagatcccgcctctacaaaatcaaaaaattagccaggcaaggtggtgcgtgcctgtcgccccagctacttggcaggctgagctcaggaggtcaagcctgccttgggccatgatcatcccatgcactccagcctgacattcagagcaagaccttgtctcaaagaaagaaaaacatttttatgggtgttttcttttttagtcttttcaataatgaaaattttcattttacagggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagaaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataa

SEQ ID NO: 437553 - DNA, 1672 bp, Homo sapiens
gccatcgcgccattcctagttaaggcggcacagggccgaggcgtagtgtgggtgactcctccgttccttgggtcccgtcgtctgtgatactgcagcgcagccatggcagaaccgcagcccccgtccggcggcctcacggacgaggccgccctcagttgctgctccgacgcggaccccagtaccaaggattttctattgcagcagaccatgctacgagtgaaggatcctaagaagtcactggatttttatactagagttcttggaatgacgctaatccaaaaatgtgattttcccattatgaagttttcactctacttcttggcttatgaggataaaaatgacatccctaaagaaaaagatgaaaaaatagcctgggcgctctccagaaaagctacacttgagctgacacacaattggggcactgaagatgatgagacccagagttaccacaatggcaattcagaccctcgaggattcggtcatattggaattgctgttcctgatgtatacagtgcttgtaaaaggtttgaagaactgggagtcaaatttgtgaagaaacctgatgatggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttatgagaaatataaacatcacttgtgtaggaatcatcaggtgtccctagagcagttttgtactaaagacttctagtgtttagtcgacgcggccgcgaat

SEQ ID NO: 437554 - DNA, 846 bp, Homo sapiens
gccatcgcgccattcctagttaaggcggcacagggccgaggcgtagtgtgggtgactcctccgttccttgggtcccgtcgtctgtgatactgcagcgcagccatggcagaaccgcagcccccgtccggcggcctcacggacgaggccgccctcagttgctgctccgacgcggaccccagtaccaaggattttctattgcagcagaccatgctacgagtgaaggatcctaagaagtcactggatttttatactagagttcttggaatgacgctaatccaaaaatgtgattttcccattatgaagttttcactctacttcttggcttatgaggataaaaatgacatccctaaagaaaaagatgaaaaaatagcctgggcgctctccagaaaagctacacttgagctgacacacaattggggcactgaagatgatgagacccagagttaccacaatggcaattcagaccctcgaggattcggtcatattggaattgctgttcctgatgtatacagtgcttgtaaaaggtttgaagaactgggagtcaaatttgtgaagaaacctgatgatggtaaaatgaaaggcctggcatttattcaagatcctgatggctactggattgaaattttgaatcctaacaaaatggcaaccttaatgtagtgctgtgagaattctcctttgagatttcagaagacgggccaccctgtgttccgctttccttccagaagcctcttgctgggggtcctggccgttcaattatctcagtcattcccttctatttagtgtctttcctcccgtcgtctcggttccagccggggtccctgctgcaatatggcaccttggggcacc

SEQ ID NO: 437555 - DNA, 535 bp, Homo sapiens
  misc_feature (8)..(8): n is a, c, g, or t
  misc_feature (11)..(11): n is a, c, g, or t
  misc_feature (17)..(17): n is a, c, g, or t
ttgacttnctncctgcngtcactctagaggatccccaatatatccggcctatccctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagaaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataa

SEQ ID NO: 437556 - DNA, 964 bp, Homo sapiens
gccatcgcgccattcctagttaaggcggcacagggccgaggcgtagtgtgggtgactcctccgttccttgggtcccgtcgtctgtgatactgcagcgcagccatggcagaaccgcagcccccgtccggcggcctcacggacgaggccgccctcagttgctgctccgacgcggaccccagtaccaaggattttctattgcagcagaccatgctacgagtgaaggatcctaagaagtcactggatttttatactagagttcttggaatgacgctaatccaaaaatgtgattttcccattatgaagttttcactctacttcttggcttatgaggataaaaatgacatccctaaagaaaaagatgaaaaaatagcctgggcgctctccagaaaagctacacttgagctgacacacaatggggcagctgaagatgatgaggatgacgatgtcgataccaagaagcagaagaccgacgaggatgactagacagcaaaaaggacaacgttatacctaagaaaaaaaaggccggcgtgacctatacaccctccattcccatctcagaatctaaaacgtggtcgccttcgagtagagaggccgcccgcccccgtggcgtgcacccgagatgaacgggctcttcacaacaaaccgaaaccatgagaatttgcacacgggggggtacaagacccaactccaggccgcttttttctaaacgtcttcaccaagcacattggttgtcatgctatgacacttacctccgtgcattgttcggccgccgtttaagatcggtgacaacagcttggggcgccggccagctgcctctgtgggaccgctcaaacccgggggaacgttaaccggtacgacacttcctcccttgctggcggccaacgtgttcgataccccgcgcacctgtggacggcgctgatctccctttttctcctctttctctcttttatctttgtcctcttcg

SEQ ID NO: 437557 - DNA, 2019 bp, Homo sapiens
accacgcgtcgcggacgcgtgggtcgcggacgcgtgggcgcacagggccgaggcgtagtgtgggtgactcctccgttccttgggtcccgtcgtctgtgatactgcagcgcagccatggcagaaccgcagcccccgtccggcggcctcacggacgaggccgccctcagttgctgctccgacgcggaccccagtaccaaggattttctattgcagcagaccatgctacgagtgaaggatcctaagaagtcactggatttttatactagagttcttggaatgacgctaatccaaaaatgtgattttcccattatgaagttttcactctacttcttggcttatgaggataaaaatgacatccctaaagaaaaagatgaaaaaatagcctgggcgctctccagaaaagctacacttgagctgacacacaattggggcactgaagatgatgagacccagagttaccacaatggcaattcagaccctcgaggattcggtcatattggaattgctgttcctgatgtatacagtgcttgtaaaaggtttgaagaactgggagtcaaatttgtgaagaaacctgatgatggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagaaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataa

SEQ ID NO: 437558 - DNA, 2415 bp, Homo sapiens
  misc_feature (2045)..(2046): n is a, c, g, or t
  misc_feature (2051)..(2051): n is a, c, g, or t
gccatcgcgccattcctagttaaggcggcacagggccgaggcgtagtgtgggtgactcctccgttccttgggtcccgtcgtctgtgatactgcagcgcagccatggcagaaccgcagcccccgtccggcggcctcacggacgaggccgccctcagttgctgctccgacgcggaccccagtaccaaggattttctattgcagcagaccatgctacgagtgaaggatcctaagaagtcactggatttttatactagagttcttggaatgacgctaatccaaaaatgtgattttcccattatgaagttttcactctacttcttggcttatgaggataaaaatgacatccctaaagaaaaagatgaaaaaatagcctgggcgctctccagaaaagctacacttgagctgacacacaattggggcactgaagatgatgagacccagagttaccacaatggcaattcagaccctcgaggattcggtcatattggaattgctgttcctgatgtatacagtgcttgtaaaaggtttgaagaactgggagtcaaatttgtgaagaaacctgatgatggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagaaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataaaaaaaaaaaaaaaaaaaaaaaaaaaaaaaaaaaaaaannaaaanaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaggggggggggggcaataatccccgggggggcgccacagatagccgaccccccccagagttagtagagaaaagaggagccgccccacaagaaagaggggatataacaaagaggcgggcccggccgaaaaaaaggcgggaacgaggaaagagccatgggctcatgggagggacacctctgggggggaatgaggcgaccaccccgagaaaaacgccggaaaaaacacaggtggatggtaacacgcatcgtgcggcgaaacgccggaggaaaaaag

SEQ ID NO: 437559 - DNA, 2381 bp, Homo sapiens
  misc_feature (2011)..(2012): n is a, c, g, or t
  misc_feature (2017)..(2017): n is a, c, g, or t
gccatcgcgccattcctagttaaggcggcacagggccgaggcgtagtgtgggtgactcctccgttccttgggtcccgtcgtctgtgatactgcagcgcagccatggcagaaccgcagcccccgtccggcggcctcacggacgaggccgccctcagttgctgctccgacgcggaccccagtaccaaggattttctattgcagcagaccatgctacgagtgaaggatcctaagaagtcactggatttttatactagagttcttggaatgacgctaatccaaaaatgtgattttcccattatgaagttttcactctacttcttggcttatgaggataaaaatgacatccctaaagaaaaagatgaaaaaatagcctgggcgctctccagaaaagctacacttgagctgacacacaattggggcactgaagatgatgagacccagagttaccacaatggcaattcagaccctcgaggattcggtcatattggaattgctgttcctgatgtatacagtgcttgtaaaaggtttgaagaactgggagtcaaatttgtgaagaaacctgatgatggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagaaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataaaaannaaaanaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaggggggggggggcaataatccccgggggggcgccacagatagccgaccccccccagagttagtagagaaaagaggagccgccccacaagaaagaggggatataacaaagaggcgggcccggccgaaaaaaaggcgggaacgaggaaagagccatgggctcatgggagggacacctctgggggggaatgaggcgaccaccccgagaaaaacgccggaaaaaacacaggtggatggtaacacgcatcgtgcggcgaaacgccggaggaaaaaag

SEQ ID NO: 437560 - DNA, 2061 bp, Homo sapiens
gccatcgcgccattcctagttaaggcggcacagggccgaggcgtagtgtgggtgactcctccgttccttgggtcccgtcgtctgtgatactgcagcgcagccatggcagaaccgcagcccccgtccggcggcctcacggacgaggccgccctcagttgctgctccgacgcggaccccagtaccaaggggcctgcaaccagaagataccactgagcagagagcccttgcaagttgtaggtggattttctattgcagcagaccatgctacgagtgaaggatcctaagaagtcactggatttttatactagagttcttggaatgacgctaatccaaaaatgtgattttcccattatgaagttttcactctacttcttggcttatgaggataaaaatgacatccctaaagaaaaagatgaaaaaatagcctgggcgctctccagaaaagctacacttgagctgacacacaattggggcactgaagatgatgagacccagagttaccacaatggcaattcagaccctcgaggattcggtcatattggaattgctgttcctgatgtatacagtgcttgtaaaaggtttgaagaactgggagtcaaatttgtgaagaaacctgatgatggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagaaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataa

SEQ ID NO: 437561 - DNA, 1953 bp, Homo sapiens
gccatcgcgccattcctagttaaggcggcacagggccgaggcgtagtgtgggtgactcctccgttccttgggtcccgtcgtctgtgatactgcagcgcagccatggcagaaccgcagcccccgtccggcggcctcacggacgaggccgccctcagttgctgctccgacgcggaccccagtaccaaggattttctattgcagcagaccatgctacgagtgaaggatcctaagaagtcactggatttttatactagagttcttggaatgacgctaatccaaaaatgtgattttcccattatgaagttttcactctacttcttggcttatgaggataaaaatgacatccctaaagaaaaagatgaaaaaatagcctgggcgctctccagaagttaccacaatggcaattcagaccctcgaggattcggtcatattggaattgctgttcctgatgtatacagtgcttgtaaaaggtttgaagaactgggagtcaaatttgtgaagaaacctgatgatggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagaaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataa

SEQ ID NO: 437562 - DNA, 2348 bp, Homo sapiens
  misc_feature (1978)..(1979): n is a, c, g, or t
  misc_feature (1984)..(1984): n is a, c, g, or t
gccatcgcgccattcctagttaaggcggcacagggccgaggcgtagtgtgggtgactcctccgttccttgggtcccgtcgtctgtgatactgcagcgcagccatggcagaaccgcagcccccgtccggcggcctcacggacgaggccgccctcagttgctgctccgacgcggaccccagtaccaaggattttctattgcagcagaccatgctacgagtgaaggatcctaagaagtcactggatttttatactagagttcttggaatgacgctaatccaaaaatgtgattttcccattatgaagttttcactctacttcttggcttatgaggataaaaatgacatccctaaagaaaaagatgaaaaaatagcctgggcgctctccagaaaagctacacttgagctgacacacaattggggcactgaagatgatgagacccagagttaccacaatggcaattcagaccctcgaggattcggtcatattggaattgctgttcctgatgtatacagtgcttgtaaaaggtttgaagaactgggagtcaaatttgtgaagaaacctgatgatggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagggaaaggccatgccaaccgtgcttgtactgctagaagcactttatgtttcctttttgggtgaaatggatttatgtgagtgctttaaacaaatagcaatacttatagactgaaataaaatgaaacttcaaataaaaaaaaaaaaaaaaaaaaaaaaaaaaaaaaaaaaaaannaaaanaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaggggggggggggcaataatccccgggggggcgccacagatagccgaccccccccagagttagtagagaaaagaggagccgccccacaagaaagaggggatataacaaagaggcgggcccggccgaaaaaaaggcgggaacgaggaaagagccatgggctcatgggagggacacctctgggggggaatgaggcgaccaccccgagaaaaacgccggaaaaaacacaggtggatggtaacacgcatcgtgcggcgaaacgccggaggaaaaaag

SEQ ID NO: 437563 - DNA, 2274 bp, Homo sapiens
  misc_feature (1904)..(1905): n is a, c, g, or t
  misc_feature (1910)..(1910): n is a, c, g, or t
gccatcgcgccattcctagttaaggcggcacagggccgaggcgtagtgtgggtgactcctccgttccttgggtcccgtcgtctgtgatactgcagcgcagccatggcagaaccgcagcccccgtccggcggcctcacggacgaggccgccctcagttgctgctccgacgcggaccccagtaccaaggattttctattgcagcagaccatgctacgagtgaaggatcctaagaagtcactggatttttatactagagttcttggaatgacgctaatccaaaaatgtgattttcccattatgaagttttcactctacttcttggcttatgaggataaaaatgacatccctaaagaaaaagatgaaaaaatagcctgggcgctctccagaaaagctacacttgagctgacacacaattggggcactgaagatgatgagacccagagttaccacaatggcaattcagaccctcgaggattcggtcatattggaattgctgttcctgatgtatacagtgcttgtaaaaggtttgaagaactgggagtcaaatttgtgaagaaacctgatgatggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcataaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataaaaaaaaaaaaaaaaaaaaaaaaaaaaaaaaaaaaaaannaaaanaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaggggggggggggcaataatccccgggggggcgccacagatagccgaccccccccagagttagtagagaaaagaggagccgccccacaagaaagaggggatataacaaagaggcgggcccggccgaaaaaaaggcgggaacgaggaaagagccatgggctcatgggagggacacctctgggggggaatgaggcgaccaccccgagaaaaacgccggaaaaaacacaggtggatggtaacacgcatcgtgcggcgaaacgccggaggaaaaaag

SEQ ID NO: 437564 - DNA, 657 bp, Homo sapiens
gccatcgcgccattcctagttaaggcggcacagggccgaggcgtagtgtgggtgactcctccgttccttgggtcccgtcgtctgtgatactgcagcgcagccatggcagaaccgcagcccccgtccggcggcctcacggacgaggccgccctcagttgctgctccgacgcggaccccagtaccaaggattttctattgcagcagaccatgctacgagtgaaggatcctaagaagtcactggatttttatactagagttcttggaatgacgctaatccaaaaatgtgattttcccattatgaagttttcactctacttcttggcttatgaggataaaaatgacatccctaaagaaaaagatgaaaaaatagcctgggcgctctccagaaaagctacacttgagctgacacacaattggggcactgaagatgatgagacccagagttaccacaatggcaattcagaccctcgaggattcggtcatattggaattgctgttcctgatgtatacagtgcttgtaaaagggaaaggccatgccaaccgtgcttgtactgctagaagcactttatgtttcctttttgggtgaaatggatttatgtgagtgctttaaacaaatagcaatacttatagactgaaataaaatgaaacttcaaataa

SEQ ID NO: 437565 - DNA, 618 bp, Homo sapiens
cttctagatgggtcgaccacagaccacagctgcttctaattggccatcttggcacctcctcatttaaccttcttttctcatctaaaggggataaaggatgaaactgtcccaaagaaaagtttataaaccaattaagggagaaaataaaattcaactaggcttgcagaataatcagtggcaatcatgaaatccacttcccaatttggcctacttccttgtagctagttacttcttactcccccaagatagtgtagcccttgtcacaagactgtgttccttttcttttctatagataagatctaaggcacatgagatgatatgctttctgtttgagtttctcctttatgttacgcatactgataaaattgttgatgccagttgatctgaaggtcccagcaaggagccgactcacagaagaatgaagttttcacatcatgatgatttaatcttccttgacctgagcaattgacaaccccaattctccagaacctcacccgccacaatccccttaaaaaccctggcccagaacccctcaagcagacagatgtgaagcttgaggattccttcatctctttgcccaatggcattgtgattattaaactctttttctgctgcaaa

SEQ ID NO: 437566 - DNA, 616 bp, Homo sapiens
gtgagttgaagagccgatgggcagcaggcagacttgagtctcctttctgtccatgagctcgggccactgtatcaggtccacccgtggctccaaaatggtctcctggtccgtgatagcaaagatccaggaaatatggtgcgaggaagatgagaggaagatggcgcgagagttcctggccgagttcatgagcacatatgtcatgatgaacatacatatgatagttgagaaagacacatattctgatcatgaagaaataaacacaagttaaatatgactaagcagaaagatggaaggaccaggaatggtgatgctaacttggaaccacgatgcaggctctaaactcctctacaatcatcctcccttgtgagaaaaatacttgatctgaaggtcccagcaaggagccgactcacagaagaatgaagttttcacatcatgatgatttaatcttccttgacctgagcaattgacaaccccaattctccagaacctcacccgccacaatccccttaaaaaccctggcccagaacccctcaagcagacagatgtgaagcttgaggattccttcatctctttgcccaatggcattgtgattattaaactctttttctgctgcaaa

SEQ ID NO: 437567 - DNA, 414 bp, Homo sapiens
gtgagttgaagagccgatgggcagcaggcagacttgagtctcctttctgtccatgagctcgggccactgtatcaggtccacccgtggctccaaaatggtctcctggtccgtgatagcaaagatccaggaaatatggtgcgaggaagatgagaggaagatggcgcgagagttcctggccgagttcatgagcacatatgtcatgatgaacatacatatgatagttgagaaagacacatattctgatcatgaagaaataaacacaagttaaatatgactaagcagaaagatggaaggaccaggaatggtgatgctaacttggaaccacgatgcaggctctaaactcctctacaatcatcctcccttgtgagaaaaatacgtaagtcacttttaaaataaatagaaacctgaacacac

SEQ ID NO: 437568 - DNA, 395 bp, Homo sapiens
tcacttgtacccgggaattggaggtttccatgagccgggatttggcccttgcaagtcggcttgggcgacagagccagactgtttccaaaaaaaaaaaaaaaaaattggctgcgtgccgaggcacatgcccatagtcccaaggtgctgggattacaggcatgagtcaccgtgcccagcccaatatcacagtcttgacccttaacctctatgctctgtaccttagcttaaatattgccagcttttaaagactggcttgttaatgctcccccagccagggtaaagtcctcactttcaggtagttcaagatgcctctctcggcctcagtttccccatttatagagtgggagaaaaattcttgctgtgcagatttgttgtgaggattgaagacagtagca

SEQ ID NO: 437569 - DNA, 601 bp, Homo sapiens
gtgagttgaagagccgatgggcagcaggcagacttgagtctcctttctgtccatgagctcgggccactgtatcaggtccacccgtggctccaaaatggtctcctggtccgtgatagcaaagatccaggaaatatggtgcgaggaagatgagaggaagatggcgcgagagttcctggccgagttcatgagcacatatgtcatgatggcatgtgcagagatgaactcactaattgttcaaaataaacaatttgaattcaaagcaaagtatatttttggaatatcaattatcacttattgcagataaatgataatataaaacaccaactttggaatttatttgttttacttctgtgactctcagccttctttttaaaatatagtgtatgttttagaacatacatatgatagttgagaaagacacatattctgatcatgaagaaataaacacaagttaaatatgactaagcagaaagatggaaggaccaggaatggtgatgctaacttggaaccacgatgcaggctctaaactcctctacaatcatcctcccttgtgagaaaaatacgtaagtcacttttaaaataaatagaaacctgaacacac

SEQ ID NO: 437570 - DNA, 602 bp, Homo sapiens
gtggggccaagttctgtgtcctccagccctagtgacctctctttggctcctcagcatctacaaatctgaaggacaaaacatggttcaagcatctgggcacaggcgaacatacatatgatagttgagaaagacacatattctgatcatgaagaaataaacacaagttaaatatgactaagcagaaagatggaaggaccaggaatggtgatgctaacttggaaccacgatgcaggctctaaactcctctacaatcatcctcccttgtgagaaaaatacataagatctaaggcacatgagatgatatgctttctgtttgagtttctcctttatgttacgcatactgataaaattgttgatgccagttgatctgaaggtcccagcaaggagccgactcacagaagaatgaagttttcacatcatgatgatttaatcttccttgacctgagcaattgacaaccccaattctccagaacctcacccgccacaatccccttaaaaaccctggcccagaacccctcaagcagacagatgtgaagcttgaggattccttcatctctttgcccaatggcattgtgattattaaactctttttctgctgcaaa

SEQ ID NO: 437571 - DNA, 949 bp, Homo sapiens
atgacattctgtggtgtagctttgcactaggacggttgtaccacgtcgtgattgggcaatacttggcgtgtgcccatttgccttgtgtctgcagtcccctggccacacccagtaacagttctgtgatctatgagaatagtttccttagcgagctttcccttcaaatactttgcagccaggtagagaagtttggagtgaagattttgttctttgtttcttcacaatatggatatgaatcttcttttgaaaacgttaaagtaaattacctcttttcagatattgtcttcatgtgaacttggtatcctgtttccatcccagccttctataacccagtaacatctttgttgaaaccagtgggtgagaaagacacctggtcaggaatgtggaccacgggccaactcaggctcgcccatggtgtcagactaaagacaaacaaggactctctgtataagaacatacatatgatagttgagaaagacacatattctgatcatgaagaaataaacacaagttaaatatgactaagcagaaagatggaaggaccaggaatggtgatgctaacttggaaccacgatgcaggctctaaactcctctacaatcatcctcccttgtgagaaaaatacataagatctaaggcacatgagatgatatgctttctgtttgagtttctcctttatgttacgcatactgataaaattgttgatgccagttgatctgaaggtcccagcaaggagccgactcacagaagaatgaagttttcacatcatgatgatttaatcttccttgacctgagcaattgacaaccccaattctccagaacctcacccgccacaatccccttaaaaaccctggcccagaacccctcaagcagacagatgtgaagcttgaggattccttcatctctttgcccaatggcattgtgattattaaactctttttctgctgcaaa

SEQ ID NO: 437572 - DNA, 863 bp, Homo sapiens
atgacattctgtggtgtagctttgcactaggacggttgtaccacgtcgtgattgggcaatacttggcgtgtgcccatttgccttgtgtctgcagtcccctggccacacccagtaacagttctgtgatctatgagaatagtttccttagcgagctttcccttcaaatactttgcagccaggtagagaagtttggagtgaagattttgttctttgtttcttcacaatatggatatgaatcttcttttgaaaacgttaaagtaaattacctcttttcagatattgtcttcatgtgaacttggtatcctgtttccatcccagccttctataacccagtaacatctttgttgaaaccagtgggtgagaaagacacctggtcaggaatgtggaccacgggccaactcaggctcgcccatggtgtcagactaaagacaaacaaggactctctgtataagaacatacatatgatagttgagaaagacacatattctgatcatgaagaaataaacacaagttaaatatgactaagcagaaagatggaaggaccaggaatggtgatgctaacttggaaccacgatgcaggctctaaactcctctacaatcatcctcccttgtgagaaaaatacttgatctgaaggtcccagcaaggagccgactcacagaagaatgaagttttcacatcatgatgatttaatcttccttgacctgagcaattgacaaccccaattctccagaacctcacccgccacaatccccttaaaaaccctggcccagaacccctcaagcagacagatgtgaagcttgaggattccttcatctctttgcccaatggcattgtgattattaaactctttttctgctgcaaa

SEQ ID NO: 437573 - DNA, 767 bp, Homo sapiens
acacagggatagctgagccccagctgggggtggaagctgagccagagacagtcacagaggaacaagatcaagatgcgctttaactgagaagcccccaaggcagaggctgagaatcagaagacatttcagcagacatctacaaatctgaaggacaaaacatggttcaagcatctgggcacaggcggtaagtaccccaccctctgatgagaggaagatggcgcgagagttcctggccgagttcatgagcacatatgtcatgatggagtggctgaccgggatgctccagctgtgtctcttcgccatcgtggaccaggagaacaacccagcactgccaggaacacacgcactggtgataggcatcctcgtggtcatcatcagggtgtaccatggcatgaacacaggatatgccatcaatccgtcccgggacctgccccccccgcatcttcaccttcattgctggttggggcaaactggtcttcaggtggcatcatctacctggtcttcattggctccaccatcccacgggagcccctgaaattggaggactctgtggcatatgaagaccacgggataactgtattgcccaagatgggatctcatgaacccatgatctctccccttaccctcatctccgtgagccctgccaacagatcttcagtccaccctgccccacccttacatgaatccatggccctagagcacttctaagcagagattatttgtgatcccatcccttccccaataaagagaagcttgtcccacagcag

SEQ ID NO: 437574 - DNA, 799 bp, Homo sapiens
acacagggatagctgagccccagctgggggtggaagctgagccagagacagtcacagaggaacaagatcaagatgcgctttaactgagaagcccccaaggcagaggctgagaatcagaagacatttcagcagacatctacaaatctgaaggacaaaacatggttcaagcatctgggcacaggcggtccacccgtggctccaaaatggtctcctggtccgtgatagcaaagatccaggaaatatggtgcgaggaagatgagaggaagatggcgcgagagttcctggccgagttcatgagcacatatgtcatgatgatacagtcttgctttgtcacagtggtgcaatctcggctcactgcaacctctacctcctgggttcaagcgattcttgcatctcagcctctggagtagctggaattacaggtgcatgccaccattgcccagccaattttttgtatttttaggaaagacaaggtttcaccatgttgtcaaggctggtcttgaactccctgacttcaagtgatcctcccacctcggcctcccaaagtgctgggattacaggcatgagtcaccgtgcccagcccaatatcacagtcttgacccttaacctctatgctctgtaccttagcttaaatattgccagcttttaaagactggcttgttaatgctcccccagccagggtaaagtcctcactttcaggtagttcaagatgcctctctcggcctcagtttccccatttatagagtgggagaaaaattcttgctgtgcagatttgttgtgaggattgaagacagtagca

SEQ ID NO: 437575 - DNA, 506 bp, Homo sapiens
ctccagctgtgtctcttcgccatcgtggaccaggagaacaacccagcactgccaggaacacacgcactggtgataggcatcctcgtggtcatcatcagggtgtaccatggcatgaacacaggatatgccatcaatccgtcccgggacctgccccccccgcatcttcaccttcattgctggttggggcaaactggtcttcaggtactgcccctgcccaggcccattcctttgagattttctgtggggcccctgtgtgttgaggtgtggggggtgatgtgaggggcagcacaggagggtcctgcagagcccccaggtggcctggggagcaggagtgagtcccaacatttccccaggccagtacagatacagatcctgcacctgcactgagtgtcaaccctgtccctgaatcgggctgaggctgaccagggccccgggttgggggtgtttcctgggttagcctgaggatgactcctctgctcaaccagtcttggcccgaggtggatgag

SEQ ID NO: 437576 - DNA, 283 bp, Homo sapiens
gtccacccgtggctccaaaatggtctcctggtccgtgatagcaaagatccaggaaatatggtgcgaggaagatgagaggaagatggcgcgagagttcctggccgagttcatgagcacatatgtcatgatggtgagtgggcgggcagcacgaagtgggtgggctctgccagggccttccatgaccccctccccattctgaccccatgggtcacattgtccattccttgcctctgagctgggagcctggggaagcagcgaggaaagtaagggggggggggctttc

SEQ ID NO: 437577 - DNA, 233 bp, Homo sapiens
gcggccgcctactactactactactgctcgaattccaagcttctaacgatgtacggggccatggtgtcagactaaagacaaacaaggactctctgtataaggtactggtcgtgtgtgtgttagtggagatgaagcctgtgctctacagacagggagtcacacagacacttttctataatttcttacatactttgaatgttcaagtataaagtctaatgttaaatttgattgaa

SEQ ID NO: 437578 - DNA, 757 bp, Homo sapiens
acacagggatagctgagccccagctgggggtggaagctgagccagagacagtcacagaggaacaagatcaagatgcgctttaactgagaagcccccaaggcagaggctgagaatcagaagacatttcagcagacatctacaaatctgaaggacaaaacatggttcaagcatctgggcacaggcggtccacccgtggctccaaaatggtctcctggtccgtgatagcaaagatccaggaaatatggtgcgaggaagatgagaggaagatggcgcgagagttcctggccgagttcatgagcacatatgtcatgatggagtggctgaccgggatgctccagctgtgtctcttcgccatcgtggaccaggagaacaacccagcactgccaggaacacacgcactggtgataggcatcctcgtggtcatcatcagggtgtaccatggcatgaacacaggatatgccatcaatccgtcccgggacctgccccccccgcatcttcaccttcattgctggttggggcaaactggtcttcaggtggcatcatctacctggtcttcattggctccaccatcccacgggagcccctgaaattggaggactctgtggcatatgaagaccacgggataactgtattgcccaagatgggatctcatgaacccatgatctctccccttaccctatatttccggggagcctgggcaaaaaaatttttatccccccctgcccccctctttcatgaattctggggccctaaccct

SEQ ID NO: 437579 - DNA, 1676 bp, Homo sapiens
gcgggggcggccgggcggcgggggcggggaaggggcgggcgcggaggcggtgccgcagcccgagccggagcccgagccggatcccgaggcgacgggagccgaacaggagccgccgctgaagccaccgccgggtgcccagcgccgccgccgcccccgagctcccccgcgcccctgcccgcgggcggccggtgggcagcgggcgccatggccgcgccggagccgctgcggccgcgcctgtgccgcttggtgcgcggagagcagggctacggcttccacctgcacggcgagaagggccgccgcgggcagttcatccggcgcgtggaacccggttcccccgccgaggccgccgcgctgcgcgctggggaccgcctggtcgaggtcaacggcgtcaacgtggagggcgagacgcaccaccaggtggtgcaaaggatcaaggctgtggaggggcagactcggctgctggtggtggaccaggagacagatgaggagctccgccggcggcagctgacctgtaccgaggagatggcccagcgagggctcccacccgcccacgacccctgggagccgaagccagactgggcacacaccggcagccacagctccgaagctggcaagaaggatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagagagagagagagagacacagagagagacagagagagagcgagcgagcgcgcggcagccgcggggcgagggcctttgctgctctgccggggcctgctgactgaaaggaatttgtgtttttgctttttttccaaaaagatctccagctccacacatgtttccacttaataccagagaccccccccccccccttcccctcccccttgggacgcgctctaaataattgcaataaaacaaacctttctctgcaaa

SEQ ID NO: 437580 - DNA, 527 bp, Homo sapiens
tcagcagcggccgtcctgagtgggagtccctgggacttcccagtggccaagttggggcgcccagcctcttcgtgggggccttgggtaaggccagggaggcctgatgtggccgtaggagctgcccctgcccacctgccctggtgtgggggtccctaggccacaccctgctccccacccagctaccctgtgcgcctgtgccctgctgggggcctgggctctccgaggggcctgaggatggaggccccacgtccccgaggagggcggcctctggacaggcccctcattccgcgcggcagctcccaggcctggggaacgtaggtgtgtgagagcggcacccgggaaggacgcctggcctctggctcagccctgcttggcgggctcccccgtggacaccctgttgactttgcacttccctcccgggccccgcacccccgaaccgaccaccgatcgaccggcaccgctgttgcctcgtaagccatagcgcatgcgcgctctcagaataaacaggccctgcctgggaaccacac

SEQ ID NO: 437581 - DNA, 1741 bp, Homo sapiens
  misc_feature (1723)..(1723): n is a, c, g, or t
  misc_feature (1727)..(1727): n is a, c, g, or t
  misc_feature (1734)..(1734): n is a, c, g, or t
gcgggggcggccgggcggcgggggcggggaaggggcgggcgcggaggcggtgccgcagcccgagccggagcccgagccggatcccgaggcgacgggagccgaacaggagccgccgctgaagccaccgccgggtgcccagcgccgccgccgcccccgagctcccccgcgcccctgcccgcgggcggccggtgggcagcgggcgccatggccgcgccggagccgctgcggccgcgcctgtgccgcttggtgcgcggagagcagggctacggcttccacctgcacggcgagaagggccgccgcgggcagttcatccggcgcgtggaacccggttcccccgccgaggccgccgcgctgcgcgctggggaccgcctggtcgaggtcaacggcgtcaacgtggagggcgagacgcaccaccaggtggtgcaaaggatcaaggctgtggaggggcagactcggctgctggtggtggaccaggagacagatgaggagctccgccggcggcagctgacctgtaccgaggagatggcccagcgagggctcccacccgcccacgacccctgggagccgaagccagactgggcacacaccggcagccacagctccgaagctggcaagaaggatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggatggcagtgcctggaagcaagatcccttccaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagagagagagagagagacacagagagagacagagagagagcgagcgagcgcgcggcagccgcggggcgagggcctttgctgctctgccggggcctgctgactgaaaggaatttgtgtttttgctttttttccaaaaagatctccagctccacacatgtttccacttaataccagagaccccccccccccccttcccctcccccttgggacgcgctctaaataattgcaataaaacaaacctttctctgcaaaaaaaagaaaaaaanacanaaaaaanaaaaaaa

SEQ ID NO: 437582 - DNA, 1674 bp, Homo sapiens
  misc_feature (89)..(89): n is a, c, g, or t
  misc_feature (153)..(153): n is a, c, g, or t
  misc_feature (162)..(162): n is a, c, g, or t
  misc_feature (195)..(195): n is a, c, g, or t
ccggccggacgcctgccacttgctgtcactgtgccgctgtcatggcacgctccgggagtgcacgccacctgcccgggctccggagcccntccacggagccaccccagaggctggtacaggatgtcagtgggcccctgaggagctgcgcctcgntctgcaccntgcgaaagggacctcagggctatgggttcaacntgcatagttccgcttggtgcgcggagagcagggctacggcttccacctgcacggcgagaagggccgccgcgggcagttcatccggcgcgtggaacccggttcccccgccgaggccgccgcgctgcgcgctggggaccgcctggtcgaggtcaacggcgtcaacgtggagggcgagacgcaccaccaggtggtgcaaaggatcaaggctgtggaggggcagactcggctgctggtggtggaccaggagacagatgaggagctccgccggcggcagctgacctgtaccgaggagatggcccagcgagggctcccacccgcccacgacccctgggagccgaagccagactgggcacacaccggcagccacagctccgaagctggcaagaaggatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggatggcagtgcctggaagcaagatcccttccaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagagagagagagagagacacagagagagacagagagagagcgagcgagcgcgcggcagccgcggggcgagggcctttgctgctctgccggggcctgctgactgaaaggaatttgtgtttttgctttttttccaaaaagatctccagctccacacatgtttccacttaataccagagaccccccccccccccttcccctcccccttgggacgcgctctaaataattgcaataaaacaaacctttctctgcaaa

SEQ ID NO: 437583 - DNA, 1220 bp, Homo sapiens
ggccaccccggccggacgcctgccacttgctgtcactgtgccgctgtcatggcacgctccgggagtgccacgccacctgcccgggctccgggagcccctccacggagcccaccccagaggctggtacaggatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggatggcagtgcctggaagcaagatcccttccaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagagagagagagagagacacagagagagacagagagagagcgagcgagcgcgcggcagccgcggggcgagggcctttgctgctctgccggggcctgctgactgaaaggaatttgtgtttttgctttttttccaaaaagatctccagctccacacatgtttccacttaataccagagaccccccccccccccttcccctcccccttgggacgcgctctaaataattgcaataaaacaaacctttctctgcaaa

SEQ ID NO: 437584 - DNA, 1501 bp, Homo sapiens
cagcggtgccaggccctggaggtggtggcagaccctgagccctctgccccctgcccctagcccatgtctccacccccatctggagggccttgggggctaagagcagccctggcctggcctggcctgtggtccctcagggacacacagggaggtaggaggtgagggaagggccctggcagcccccagcccgcctgcacagtctcccctgcgcacgccctcaagcttggcgctccctggaaacctgagctgcctcctgcctgctccggccaccgccatgtttaactgagcacgggcagccgctggccaccgccgccgcaccctggcccaccccctggctgggaggtggtcattgggcctggccttgcctgcatggtcccctggcccagagccctacctgcaggatgccagaggatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggatggcagtgcctggaagcaagatcccttccaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagagagagagagagagacacagagagagacagagagagagcgagcgagcgcgcggcagccgcggggcgagggcctttgctgctctgccggggcctgctgactgaaaggaatttgtgtttttgctttttttccaaaaagatctccagctccacacatgtttccacttaataccagagaccccccccccccccttcccctcccccttgggacgcgctctaaataattgcaataaaacaaacctttctctgcaaa

SEQ ID NO: 437585 - DNA, 1653 bp, Homo sapiens
gcgggggcggccgggcggcgggggcggggaaggggcgggcgcggaggcggtgccgcagcccgagccggagcccgagccggatcccgaggcgacgggagccgaacaggagccgccgctgaagccaccgccgggtgcccagcgccgccgccgcccccgagctcccccgcgcccctgcccgcgggcggccggtgggcagcgggcgccatggccgcgccggagccgctgcggccgcgcctgtgccgcttggtgcgcggagagcagggctacggcttccacctgcacggcgagaagggccgccgcgggcagttcatccggcgcgtggaacccggttcccccgccgaggccgccgcgctgcgcgctggggaccgcctggtcgaggtcaacggcgtcaacgtggagggcgagacgcaccaccaggtggtgcaaaggatcaaggctgtggaggggcagactcggctgctggtggtggaccaggagacagatgaggagctccgccggcggcagctgacctgtaccgaggagatggcccagcgagggctcccacccgcccacgacccctgggagccgaagccagactgggcacacaccggcagccacagctccgaagctggcaagaaggatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggatggcagtgcctggaagcaagatcccttccaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacacagccgcggggcgagggcctttgctgctctgccggggcctgctgactgaaaggaatttgtgtttttgctttttttccaaaaagatctccagctccacacatgtttccacttaataccagagaccccccccccccccttcccctcccccttgggacgcgctctaaataattgcaataaaacaaacctttctctgcaaa

SEQ ID NO: 437586 - DNA, 956 bp, Homo sapiens
gcgggggcggccgggcggcgggggcggggaaggggcgggcgcggaggcggtgccgcagcccgagccggagcccgagccggatcccgaggcgacgggagccgaacaggagccgccgctgaagccaccgccgggtgcccagcgccgccgccgcccccgagctcccccgcgcccctgcccgcgggcggccggtgggcagcgggcgccatggccgcgccggagccgctgcggccgcgcctgtgccgcttggtgcgcggagagcagggctacggcttccacctgcacggcgagaagggccgccgcgggcagttcatccggcgcgtggaacccggttcccccgccgaggccgccgcgctgcgcgctggggaccgcctggtcgaggtcaacggcgtcaacgtggagggcgagacgcaccaccaggtggtgcaaaggatcaaggctgtggaggggcagactcggctgctggtggtggaccaggagacagatgaggagctccgccggcggcagctgacctgtaccgaggagatggcccagcgagggctcccacccgcccacgacccctgggagccgaagccagactgggcacacaccggcagccacagctccgaagctggcaagaaggatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtgaacgggcagaatgtggagggactgcgccatgctgaggtggtggccagcatcaaggcacgggaggacgaggcccgatcgaccggcaccgctgttgcctcgtaagccatagcgcatgcgcgctctcagaataaacaggccctgcctgggaaccacac

SEQ ID NO: 437587 - DNA, 613 bp, Homo sapiens
gcgggggcggccgggcggcgggggcggggaaggggcgggcgcggaggcggtgccgcagcccgagccggagcccgagccggatcccgaggcgacgggagccgaacaggagccgccgctgaagccaccgccgggtgcccagcgccgccgccgcccccgagctcccccgcgcccctgcccgcgggcggccggtgggcagcgggcgccatggccgcgccggagccgctgcggccgcgcctgtgccgcttggtgcgcggagagcagggctacggcttccacctgcacggcgagaagggccgccgcgggcagttcatccggcgcgtggaacccggttcccccgccgaggccgccgcgctgcgcgctggggaccgcctggtcgaggtcaacggcgtcaacgtggagggcgagacgcaccaccaggtgggggccagcgctcgcccccggcccgccgccccctccccgagcgcgtccccctggggcgagcaggggtcgcacgggggcccgagggggctcccgcggggaggacgcggacgttgtcgggaggcagcggcccggcgccttcggagtcccggcgcaggaagctcagtcctgcacgggggtgggggggggcatcctg

SEQ ID NO: 437588 - DNA, 1709 bp, Homo sapiens
gcgggggcggccgggcggcgggggcggggaaggggcgggcgcggaggcggtgccgcagcccgagccggagcccgagccggatcccgaggcgacgggagccgaacaggagccgccgctgaagccaccgccgggtgcccagcgccgccgccgcccccgagctcccccgcgcccctgcccgcgggcggccggtgggcagcgggcgccatggccgcgccggagccgctgcggccgcgcctgtgccgcttggtgcgcggagagcagggctacggcttccacctgcacggcgagaagggccgccgcgggcagttcatccggcgcgtggaacccggttcccccgccgaggccgccgcgctgcgcgctggggaccgcctggtcgaggtcaacggcgtcaacgtggagggcgagacgcaccaccaggtggtgcaaaggatcaaggctgtggaggggcagactcggctgctggtggtggaccaggagacagatgaggagctccgccggcggcagctgacctgtaccgaggagatggcccagcgagggctcccacccgcccacgacccctgggagccgaagccagactgggcacacaccggcagccacagctccgaagctggcaagaaggatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggatggcagtgcctggaagcaagatcccttccaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagagagagagagagagacacagagagagacagagagagagcgagcgagcgcgcggcagccgcggggcgagggcctttgctgctctgccggggcctgctgactgaaaggaatttgtgtttttgctttttttccaaaaagatctccagctccacacatgtttccacttaataccagagaccccccccccccccttcccctcccccttgggacgcgctctaaataattgcaataaaacaaacctttctctgcaaa

SEQ ID NO: 437589 - DNA, 739 bp, Homo sapiens
  misc_feature (89)..(89): n is a, c, g, or t
  misc_feature (153)..(153): n is a, c, g, or t
  misc_feature (162)..(162): n is a, c, g, or t
  misc_feature (195)..(195): n is a, c, g, or t
ccggccggacgcctgccacttgctgtcactgtgccgctgtcatggcacgctccgggagtgcacgccacctgcccgggctccggagcccntccacggagccaccccagaggctggtacaggatgtcagtgggcccctgaggagctgcgcctcgntctgcaccntgcgaaagggacctcagggctatgggttcaacntgcatagttccgcttggtgcgcggagagcagggctacggcttccacctgcacggcgagaagggccgccgcgggcagttcatccggcgcgtggaacccggttcccccgccgaggccgccgcgctgcgcgctggggaccgcctggtcgaggtcaacggcgtcaacgtggagggcgagacgcaccaccaggtggtgcaaaggatcaaggctgtggaggggcagactcggctgctggtggtggaccaggagacagatgaggagctccgccggcggcagctgacctgtaccgaggagatggcccagcgagggctcccacccgcccacgacccctgggagccgaagccagactgggcacacaccggcagccacagctccgaagctggcaagaagctgactgaaaggaatttgtgtttttgctttttttccaaaaagatctccagctccacacatgtttccacttaataccagagaccccccccccccccttcccctcccccttgggacgcgctctaaataattgcaataaaacaaacctttctctgcaaa

SEQ ID NO: 437590 - DNA, 1384 bp, Homo sapiens
cgcacgcctgggccagcccagagtggtgccactgcccatgtgctgcccggaatgtgggccactgacccgctcctatcgcccattcgccccaggtggtgcaaaggatcaaggctgtggaggggcagactcggctgctggtggtggaccaggagacagatgaggagctccgccggcggcagctgacctgtaccgaggagatggcccagcgagggctcccacccgcccacgacccctgggagccgaagccagactgggcacacaccggcagccacagctccgaagctggcaagaaggatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggatggcagtgcctggaagcaagatcccttccaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagagagagagagagagacacagagagagacagagagagagcgagcgagcgcgcggcagccgcggggcgagggcctttgctgctctgccggggcctgctgactgaaaggaatttgtgtttttgctttttttccaaaaagatctccagctccacacatgtttccacttaataccagagaccccccccccccccttcccctcccccttgggacgcgctctaaataattgcaataaaacaaacctttctctgcaaa

SEQ ID NO: 437591 - DNA, 1712 bp, Homo sapiens
ggcagggcctgggatggtagcggggggtccttccgggcaccaggaggccctctgtgccctgtccacactaagctcctgccccagcccctgcttgctgggcccacgggggtggggcggctcattttcctggaatgtgaaagcaaacagagccgccaccgcagccagccccacggaggcctctggagagaaaacaaaactgctggcctaggagcgcctgccccacgctctggaggagagcccggggcagggggacgcacaggcagagccctcagggacaaccgccccaggaggccgacggcgacagttcatcccacctggtgcttcctcccaccctgcctgtgcgccacgctggcctcgagccaaaggaattctcccagcaacccgggaaggcggctgggcccgtcggggaggcttctgggtttgaaaacaggctttgcccaagttcccacagctaaagctctgtcacaggcagcctgggtgcccggagtgtttgccactgagacctgggcctgcccgtggggggcacggtaccgagtttgggcagtggcggcaccaccggggagtggcctctggaggcgggaggctggagcaagagactgaccctgtccgttgggcctgcaggatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggatggcagtgcctggaagcaagatcccttccaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagagagagagagagagacacagagagagacagagagagagcgagcgagcgcgcggcagccgcggggcgagggcctttgctgctctgccggggcctgctgactgaaaggaatttgtgtttttgctttttttccaaaaagatctccagctccacacatgtttccacttaataccagagaccccccccccccccttcccctcccccttgggacgcgctctaaataattgcaataaaacaaacctttctctgcaaa

SEQ ID NO: 437592 - DNA, 977 bp, Homo sapiens
tcgcggaaatctctgacacgccgcagacatcctaggaccctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggatggcagtgcctggaagcaagatcccttccaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagagagagagagagagacacagagagagacagagagagagcgagcgagcgcgcggcagccgcggggcgagggcctttgctgctctgccggggcctgctgactgaaaggaatttgtgtttttgctttttttccaaaaagatctccagctccacacatgtttccacttaataccagagaccccccccccccccttcccctcccccttgggacgcgctctaaataattgcaataaaacaaacctttctctgcaaa

SEQ ID NO: 437593 - DNA, 774 bp, Homo sapiens
gcgggggcggccgggcggcgggggcggggaaggggcgggcgcggaggcggtgccgcagcccgagccggagcccgagccggatcccgaggcgacgggagccgaacaggagccgccgctgaagccaccgccgggtgcccagcgccgccgccgcccccgagctcccccgcgcccctgcccgcgggcggccggtgggcagcgggcgccatggccgcgccggagccgctgcggccgcgcctgtgccgcttggtgcgcggagagcagggctacggcttccacctgcacggcgagaagggccgccgcgggcagttcatccggcgcgtggaacccggttcccccgccgaggccgccgcgctgcgcgctggggaccgcctggtcgaggtcaacggcgtcaacgtggagggcgagacgcaccaccaggtggtgcaaaggatcaaggctgtggaggggcagactcggctgctggtggtggaccaggagacagatgaggagctccgccggcggcagctgacctgtaccgaggagatggcccagcgagggctcccacccgcccacgacccctgggagccgaagccagactgggcacacaccggcagccacagctccgaagctggcaagaagctgactgaaaggaatttgtgtttttgctttttttccaaaaagatctccagctccacacatgtttccacttaataccagagaccccccccccccccttcccctcccccttgggacgcgctctaaataattgcaataaaacaaacctttctctgcaaa

SEQ ID NO: 437594 - DNA, 1224 bp, Homo sapiens
aaagataaagcctttcaaatttgaggaagaccttcggtcccgcctccatttcacgtccggcttaccgtcgtttacgacagtgtcaggatcgcgggcttgctttccggtagcgtgggctgacgcctcgctcaatttctcacagggctgcgcaggtttcccccgtctgcgaatggaccactggaggggttcaaaggttcgcgtcccagtacgggaatgagcctctttgatctcttccggggctttttcggctttcctggacctcggagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagcgatatgggggcctggaccttgccttcccatcctcctgaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaacagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactgtggtggacagtgagggccggacagagactacagtaacccgacacgaagcagatagcagtcctaggggtgatccagaatcaccaagacctccagccctggatgatgccttttccatcctggacttattcctgggacgttggttccggtcccggtagccttgttaaccctcagaggccttcaagtcctttccacctctcacccattgcccaccattaataagcttagcttctcttgccacctcaggggcttggatatgtggaatagtgaactggggccatgtcagtttgtcactcacccaaactgaccaataaaacctttatttatgct

SEQ ID NO: 437595 - DNA, 976 bp, Homo sapiens
aaagataaagcctttcaaatttgaggaagaccttcggtcccgcctccatttcacgtccggcttaccgtcgtttacgacagtgtcaggatcgcgggcttgctttccggtagcgtgggctgacgcctcgctcaatttctcacagggctgcgcaggtttcccccgtctgcgaatggaccactggaggggttcaaaggttcgcgtcccagtacgggaatgagcctctttgatctcttccggggctttttcggctttcctggacctcggagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagcgatatgggggcctggaccttgccttcccatcctcctgaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaacagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatggtttgggggcgcggcgtggtgcagggggggaaaaaaagaccggcaaaaaaggccgggggcaaaacaaccccgggggtcccgcaaagagggcggcgggcgacca

SEQ ID NO: 437596 - DNA, 1276 bp, Homo sapiens
aaagataaagcctttcaaatttgaggaagaccttcggtcccgcctccatttcacgtccggcttaccgtcgtttacgacagtgtcaggatcgcgggcttgctttccggtagcgtgggctgacgcctcgctcaatttctcacagggctgcgcaggtttcccccgtctgcgaatggaccactggaggggttcaaaggttcgcgtcccagtacgggaatgagcctctttgatctcttccggggctttttcggctttcctggacctcggagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagcgatatgggggcctggaccttgccttcccatcctcctgaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaacagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactgtggtggacagtgagggccggacagagactacagtaacccgacacgaagcagatagcagtcctaggggtgatccagaatcaccaagacctccagccctggatgatgccttttccatcctggacttattcctgggacgttggttccggtcccggtagccttgttaaccctcagaggccttcaagtcctttccacctctcacccattgcccaccattaataagcttagcttctcttgccacctcaggggcttggatatgtggaatagtgaactggggccatgtcagtttgtcactcaccatgcataactttttgtaaaaaaaatcggctttgggcggcaggtagcgtcctccgccttgaggatcggctgggtcgagagccta

SEQ ID NO: 437597 - DNA, 1151 bp, Homo sapiens
gcacgacccggccaactgaacaagaatccgcggcacaacatacggcaggtagcgaggcctgggtgtcggggctgcgcaggtttcccccgtctgcgaatggaccactggaggggttcaaaggttcgcgtcccagtacgggaatgagcctctttgatctcttccggggctttttcggctttcctggacctcggagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagcgatatgggggcctggaccttgccttcccatcctcctgaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaacagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactgtggtggacagtgagggccggacagagactacagtaacccgacacgaagcagatagcagtcctaggggtgatccagaatcaccaagacctccagccctggatgatgccttttccatcctggacttattcctgggacgttggttccggtcccggtagccttgttaaccctcagaggccttcaagtcctttccacctctcacccattgcccaccattaataagcttagcttctcttgccacctcaggggcttggatatgtggaatagtgaactggggccatgtcagtttgtcactcacccaaactgaccaataaaacctttatttatgct

SEQ ID NO: 437598 - DNA, 1116 bp, Homo sapiens
  misc_feature (1)..(1): n is a, c, g, or t
naaacttacggctaggtacgaggctgggtgttagggctgcgcaggtttcccccgtctgcgaatggaccactggaggggttcaaaggttcgcgtcccagtacgggaatgagcctctttgatctcttccggggctttttcggctttcctggacctcggagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagcgatatgggggcctggaccttgccttcccatcctcctgaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaacagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactgtggtggacagtgagggccggacagagactacagtaacccgacacgaagcagatagcagtcctaggggtgatccagaatcaccaagacctccagccctggatgatgccttttccatcctggacttattcctgggacgttggttccggtcccggtagccttgttaaccctcagaggccttcaagtcctttccacctctcacccattgcccaccattaataagcttagcttctcttgccacctcaggggcttggatatgtggaatagtgaactggggccatgtcagtttgtcactcacccaaactgaccaataaaacctttatttatgct

SEQ ID NO: 437599 - DNA, 1183 bp, Homo sapiens
aaagataaagcctttcaaatttgaggaagaccttcggtcccgcctccatttcacgtccggcttaccgtcgtttacgacagtgtcaggatcgcgggcttgctttccggtagcgtgggctgacgcctcgctcaatttctcacagggctgcgcaggtttcccccgtctgcgaatggaccactggaggggttcaaaggttcgcgtcccagtacgggaatgagcctctttgatctcttccggggctttttcggctttcctggacctcggagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagcgatatgggggcctggaccttgccttcccatcctcctgaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaacagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactgtggtggacagtgagggccggacagagactacagtaacccgacacgaagcagatagcagtcctaggggtgtccagaatcacagaactcagcctgatgaggctttcatcctggattatctggaacgtggtccggccgtaacttgttaacctcaagggttaagtctttcactccttcccctggcccataataggggttgtcccaggggctttggaaagggcgctggtcccccagcaaactcttttaacaaggggggacaggcagcgacgtatgcggagaacggacgagg

SEQ ID NO: 437600 - DNA, 1410 bp, Homo sapiens
aaagataaagcctttcaaatttgaggaagaccttcggtcccgcctccatttcacgtccggcttaccgtcgtttacgacagtgtcaggatcgcgggcttgctttccggtagcgtgggctgacgcctcgctcaatttctcacagggctgcgcaggtttcccccgtctgcgaatggaccactggaggggttcaaaggttcgcgtcccagtacgggaatgagcctctttgatctcttccggggctttttcggctttcctggacctcggagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagcgatatgggggcctggaccttgccttcccatcctcctgaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaacagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatggggtgagttgaaagaaagaggtaaaggaaagtatggccagggaacgaatgccctgaaacagggatctgtgtaaagaaactgctgagcataacctttagtaacattcggaatatggtggggacttctctttgtagatagtggaggagcgccggactgtggtggacagtgagggccggacagagactacagtaacccgacacgaagcagatagcagtcctaggggtgatccagaatcaccaagacctccagccctggatgatgccttttccatcctggacttattcctgggacgttggttccggtcccggtagccttgttaaccctcagaggccttcaagtcctttccacctctcacccattgcccaccattaataagcttagcttctcttgccacctcaggggcttggatatgtggaatagtgaactggggccatgtcagtttgtcactcacccaaactgaccaataaaacctttatttatgcttttagcataaataaaggtcgagcggccgaaaatttagtagtagtaggcggctgc

SEQ ID NO: 437601 - DNA, 1003 bp, Homo sapiens
ggacatgaaatgattgtcactggaggattaaaactttaacgaatactaataatcattaaaatattggtaactacctatagaactttatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagcgatatgggggcctggaccttgccttcccatcctcctgaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaacagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactgtggtggacagtgagggccggacagagactacagtaacccgacacgaagcagatagcagtcctaggggtgatccagaatcaccaagacctccagccctggatgatgccttttccatcctggacttattcctgggacgttggttccggtcccggtagccttgttaaccctcagaggccttcaagtcctttccacctctcacccattgcccaccattaataagcttagcttctcttgccacctcaggggcttggatatgtggaatagtgaactggggccatgtcagtttgtcactcacccaaactgaccaataaaacctttatttatgct

SEQ ID NO: 437602 - DNA, 1080 bp, Homo sapiens
aaagataaagcctttcaaatttgaggaagaccttcggtcccgcctccatttcacgtccggcttaccgtcgtttacgacagtgtcaggatcgcgggcttgctttccggtagcgtgggctgacgcctcgctcaatttctcacagggctgcgcaggtttcccccgtctgcgaatggaccactggaggggttcaaaggttcgcgtcccagtacgggaatgagcctctttgatctcttccggggctttttcggctttcctggacctcggagcttcagcccaggaggagggatacgtttccacgataacttcggctttgatgacctagtacgagatttcaatagcatcttcagcgatatgggggcctggaccttgccttcccatcctcctgaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaacagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactgtggtggacagtgagggccggacagagactacagtaacccgacacgaagcagatagcagtcctaggggtgatccagaatcaccaagacctccagccctggatgatgccttttccatcctggacttattcctgggacgttggttccggtcccggtagccttgttaaccctcagaggccttcaagtcctttccacctctcacccattgcccaccattaataagcttagcttctcttgccacctcaggggcttggatatgtggaatagtgaactggggccatgtcagtttgtcactcacccaaactgaccaataaaacctttatttatgct

SEQ ID NO: 437603 - DNA, 1399 bp, Homo sapiens
aaagataaagcctttcaaatttgaggaagaccttcggtcccgcctccatttcacgtccggcttaccgtcgtttacgacagtgtcaggatcgcgggcttgctttccggtagcgtgggctgacgcctcgctcaatttctcacagggctgcgcaggtttcccccgtctgcgaatggaccactggaggggttcaaaggttcgcgtcccagtacgggaatgagcctctttgatctcttccggggctttttcggctttcctggacctcggagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagcgatatgggggcctggaccttgccttcccatcctcctggtgtgtggctttccctaaggggcaacctgtggtttctggtgggttggtgggtgaaataaagagcctgcagggagtagctgggggatgggaagtgtgagaagactgatgatttcagagagattaatagagcccaagtcctttcccatcccagcaaacacctgccacctttctgcagaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaacagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactgtggtggacagtgagggccggacagagactacagtaacccgacacgaagcagatagcagtcctaggggtgatccagaatcaccaagacctccagccctggatgatgccttttccatcctggacttattcctgggacgttggttccggtcccggtagccttgttaaccctcagaggccttcaagtcctttccacctctcacccattgcccaccattaataagcttagcttctcttgccacctcaggggcttggatatgtggaatagtgaactggggccatgtcagtttgtcactcacccaaactgaccaataaaacctttatttatgct

SEQ ID NO: 437604 - DNA, 853 bp, Homo sapiens
  misc_feature (1)..(1): n is a, c, g, or t
naaacttacggctaggtacgaggctgggtgttagggctgcgcaggtttcccccgtctgcgaatggaccactggaggggttcaaaggttcgcgtcccagtacgggaatgagcctctttgatctcttccggggctttttcggctttcctggacctcggagaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaacagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactgtggtggacagtgagggccggacagagactacagtaacccgacacgaagcagatagcagtcctaggggtgatccagaatcaccaagacctccagccctggatgatgccttttccatcctggacttattcctgggacgttggttccggtcccggtagccttgttaaccctcagaggccttcaagtcctttccacctctcacccattgcccaccattaataagcttagcttctcttgccacctcaggggcttggatatgtggaatagtgaactggggccatgtcagtttgtcactcacccaaactgaccaataaaacctttatttatgct

SEQ ID NO: 437605 - DNA, 804 bp, Homo sapiens
catatcgctgaagatgctattgaaatctcgtactaggtcatcaaagccgaagttatcgtggaaacgtatccctcctcctgggcctggaccttgccttcccatcctcctgaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaacagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactgtggtggacagtgagggccggacagagactacagtaacccgacacgaagcagatagcagtcctaggggtgatccagaatcaccaagacctccagccctggatgatgccttttccatcctggacttattcctgggacgttggttccggtcccggtagccttgttaaccctcagaggccttcaagtcctttccacctctcacccattgcccaccattaataagcttagcttctcttgccacctcaggggcttggatatgtggaatagtgaactggggccatgtcagtttgtcactcacccaaactgaccaataaaacctttatttatgct

SEQ ID NO: 437606 - DNA, 646 bp, Homo sapiens
tgttctagaggataccctctggatgcaagtgtcagatagtcaccagcccaggatctttgggggggtcttggagagtgatgcaagaagtgaatccccccaacagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactgtggtggacagtgagggccggacagagactacagtaacccgacacgaagcagatagcagtcctaggggtgatccagaatcaccaagacctccagccctggatgatgccttttccatcctggacttattcctgggacgttggttccggtcccggtagccttgttaaccctcagaggccttcaagtcctttccacctctcacccattgcccaccattaataagcttagcttctcttgccacctcaggggcttggatatgtggaatagtgaactggggccatgtcagtttgtcactcacccaaactgaccaataaaacctttatttatgct

SEQ ID NO: 437607 - DNA, 840 bp, Homo sapiens
aaagataaagcctttcaaatttgaggaagaccttcggtcccgcctccatttcacgtccggcttaccgtcgtttacgacagtgtcaggatcgcgggcttgctttccggtagcgtgggctgacgcctcgctcaatttctcacagggctgcgcaggtttcccccgtctgcgaatggaccactggaggggttcaaaggttcgcgtcccagtacgggaatgagcctctttgatctcttccggggctttttcggctttcctggacctcggagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagcgatatgggggcctggaccttgccttcccatcctcctgaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaacagcaccagactggggctcccagaggccatttcataggcctccgcggaggcgagaggaccttcgtctccctgagggagacctggcaaggagattgagcagaagtgcgactgtggagaagagatcctgatacacggtgtctctctgccatgacagacgaggca

SEQ ID NO: 437608 - DNA, 1380 bp, Homo sapiens
aaagataaagcctttcaaatttgaggaagaccttcggtcccgcctccatttcacgtccggcttaccgtcgtttacgacagtgtcaggatcgcgggcttgctttccggtagcgtgggctgacgcctcgctcaatttctcacagggctgcgcaggtttcccccgtctgcgaatggaccactggaggggttcaaaggttcgcgtcccagtacgggaatgagcctctttgatctcttccggggctttttcggctttcctggacctcggagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagcgatatgggggcctggaccttgccttcccatcctcctgcaaacacctgccacctttctgcagaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaacagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatggggtgagttgaaagaaagaggtaaaggaaagtatggccagggaacgaatgccctgaaacagggatctgtgtaaagaaactgctgagcataacctttagtaacattcggaatatggtggggacttctctttgtagatagtggaggagcgccggactgtggtggacagtgagggccggacagagactacagtaacccgacacgaagcagatagcagtcctaggggtgatccagaatcaccaagacctccagccctggatgatgccttttccatcctggacttattcctgggacgttggttccggtcccggtagccttgttaaccctcagaggccttcaagtcctttccacctctcacccattgcccaccattaataagcttagcttctcttgccacctcaggggcttggatatgtggaatagtgaactggggccatgtcagtttgtcactcacccaaactgaccaataaaacctttatttatgct

SEQ ID NO: 437609 - DNA, 238 bp, Homo sapiens
ggtctatgacctttcaaatttcagattggaaggagtcttttcacttactatggtttcttctgcagtttgatgatgtatggcctatggacccccatcctagaaccagagaggacaatggtaagtctggaggaaggggaagtttaccagccttttgttattcttctgaagttctgtgtgttctccctccctgaagtttcttcctgtacacttgtctccttttttcctttggactctttct

SEQ ID NO: 437610 - DNA, 1597 bp, Homo sapiens
aaagataaagcctttcaaatttgaggaagaccttcggtcccgcctccatttcacgtccggcttaccgtcgtttacgacagtgtcaggatcgcgggcttgctttccggtagcgtgggctgacgcctcgctcaatttctcacagggctgcgcaggtttcccccgtctgcgaatggaccactggaggggttcaaaggttcgcgtcccagtacgggaatgagcctctttgatctcttccggggctttttcggctttcctggacctcggagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagcgatatgggggcctggaccttgccttcccatcctcctgaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaacagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactgtggtggacagtgagggccggacagagactacagtaacccgacacgaagcagatagcagtcctaggggtgatccagaatcaccaagacctccagccctggatgatgccttttccatcctggacttattcctgggacgttggttccggtcccggtagccttgttaaccctcagaggccttcaagtcctttccacctctcacccattgcccaccattaataagcttagcttctcttgccacctcaggggcttggatatgtggaatagtgaactggggccatgtcagtttgtcactcacccaaactgaccaataaaacctttatttatgcttaaaaaaaacaacaaaaacaaacaaaattgtgcgggcgacaaggacccaaagaaattagaaccctcccgtggggcgccgggccattagtaatgaacatgggcaacagggaccagagaatcggggtacaaagggggtgtctccccaaaaagagccgggaagcgcaggttgtgaacacaggcggtgggggccagggattcacaggggcgagtaggaaccccccggcgcagggagcaacaacgcaagacaagaacaacagaggacgacaagcagcagcagacgggagcaaagcagcaaaacgagcgaagacacagaagcacgaacgtgcacgaaccagacagggagcccgcccaccgcaccagaagaagaaaaacc

SEQ ID NO: 437611 - DNA, 1011 bp, Homo sapiens
aaagagcaggctgtaccggtctgggagtacggatggggctttttcggctttcctggacctcggagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagcgatatgggggcctggaccttgccttcccatcctcctgaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaacagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactgtggtggacagtgagggccggacagagactacagtaacccgacacgaagcagatagcagtcctaggggtgatccagaatcaccaaggacttcatgcctggatgatgcatattaccaatcctgtgactatattcatgggacaggtagggtaccagagaacacagagaagcattggaaaacacgtacagaaggcatcaacagaccattacaacaacatcaaacataggcgaaccacacacaccgttacctaacactgcaagtaacgggagcatagaaaacaggaaaaggaacaggccaagacaacaaagacatccacg

SEQ ID NO: 437612 - DNA, 1572 bp, Homo sapiens
  misc_feature (1572)..(1572): n is a, c, g, or t
aaagataaagcctttcaaatttgaggaagaccttcggtcccgcctccatttcacgtccggcttaccgtcgtttacgacagtgtcaggatcgcgggcttgctttccggtagcgtgggctgacgcctcgctcaatttctcacagggctgcgcaggtttcccccgtctgcgaatggaccactggaggggttcaaaggttcgcgtcccagtacgggaatgagcctctttgatctcttccggggctttttcggctttcctggacctcggagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagcgatatgggggcctggaccttgccttcccatcctcctgaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaacagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactgtggtggacagtgagggccggacagagactacagtaacccgacacgaagcagatagcagtcctaggggtgatccagaatcaccaagacctccagccctggatgatgccttttccatcctggacttattcctgggacgttggttccggtcccggtagccttgttaaccctcagaggccttcaagtcctttccacctctcacccattgcccaccattaataagcttagcttctcttgccacctcaggggcttggatatgtggaatagtgaactggggccatgtcagtttgtcactcacccaaactgaccaataaaacctttatttatgctaaaaaaaaaaaaaaaaaaaaaaaaaacagaaaaaaaaaccaaaaaaaaaaacaaaaacacatagcacaaacaaaagaggaggggcgggccgcctgatgagaagattcaaccccagccgagggggcccacgacgctgtgctgccccaccccaccttttgtctcggaccacagatgggcgccccctaatggggtgcgccttcctttcttcaaggcgcgcgcggggcgcctgccgtctttttcacccccggtctgtctcggggggacacacgggcgtcgctgcgtgctcactctctggcgcgggacccctctctccggggcgggtgccccttctggcgccctcccgcctcn

SEQ ID NO: 437613 - DNA, 1356 bp, Homo sapiens
aaagataaagcctttcaaatttgaggaagaccttcggtcccgcctccatttcacgtccggcttaccgtcgtttacgacagtgtcaggatcgcgggcttgctttccggtagcgtgggctgacgcctcgctcaatttctcacagggctgcgcaggtttcccccgtctgcgaatggaccactggaggggttcaaaggttcgcgtcccagtacgggaatgagcctctttgatctcttccggggctttttcggctttcctggacctcggagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagcgatatgggggcctggaccttgccttcccatcctcctgaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaacagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactgtggtggacagtgagggccggacagagactacagtaacccgacacgaagcagatagcagtcctaggggtggtaagttaaaagacaaaggggttcatctcaagattccttggggaagggaaatcttactcttctacccttgtcctttgcttctgcctagtctctttcatttagcctatttacgtgtatgactttcttccttagatccagaatcaccaagacctccagccctggatgatgccttttccatcctggacttattcctgggacgttggttccggtcccggtagccttgttaaccctcagaggccttcaagtcctttccacctctcacccattgcccaccattaataagcttagcttctcttgccacctcaggggcttggatatgtggaatagtgaactggggccatgtcagtttgtcactcacccaaactgaccaataaaacctttatttatgct

SEQ ID NO: 437614 - DNA, 1356 bp, Homo sapiens
aaagataaagcctttcaaatttgaggaagaccttcggtcccgcctccatttcacgtccggcttaccgtcgtttacgacagtgtcaggatcgcgggcttgctttccggtagcgtgggctgacgcctcgctcaatttctcacagggctgcgcaggtttcccccgtctgcgaatggaccactggaggggttcaaaggttcgcgtcccagtacgggaatgagcctctttgatctcttccggggctttttcggctttcctggacctcggagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagcgatatgggggcctggaccttgccttcccatcctcctgaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaacagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatggggtgagttgaaagaaagaggtaaaggaaagtatggccagggaacgaatgccctgaaacagggatctgtgtaaagaaactgctgagcataacctttagtaacattcggaatatggtggggacttctctttgtagatagtggaggagcgccggactgtggtggacagtgagggccggacagagactacagtaacccgacacgaagcagatagcagtcctaggggtgatccagaatcaccaagacctccagccctggatgatgccttttccatcctggacttattcctgggacgttggttccggtcccggtagccttgttaaccctcagaggccttcaagtcctttccacctctcacccattgcccaccattaataagcttagcttctcttgccacctcaggggcttggatatgtggaatagtgaactggggccatgtcagtttgtcactcacccaaactgaccaataaaacctttatttatgct

SEQ ID NO: 437615 - DNA, 1223 bp, Homo sapiens
  misc_feature (878)..(878): n is a, c, g, or t
aaagataaagcctttcaaatttgaggaagaccttcggtcccgcctccatttcacgtccggcttaccgtcgtttacgacagtgtcaggatcgcgggcttgctttccggtagcgtgggctgacgcctcgctcaatttctcacagggctgcgcaggtttcccccgtctgcgaatggaccactggaggggttcaaaggttcgcgtcccagtacgggaatgagcctctttgatctcttccggggctttttcggctttcctggacctcggagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagcgatatgggggcctggaccttgccttcccatcctcctgaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaacagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatggcaanaccagccacactcgtacttcgtgaaggaccctggcaaggctacaccccaccgccacagttctccatgagaaagatcatcctccgtgagatcaaccaaggcagatgtgacagcaagggcctcggaccccatggcaggggtggtgtcttcatgagggaggggcccaaagcccttgtgggcggacctcccctgagcctgtctgaggggccagcccttagtgcattcaggctaaggcccctgggcaaggatgccacccctgctcattcggaggaagtgccctcacccctcactggtccaatggcttgagactcaccccgtctgcccagtaaaagcctttttgcagcaaa

SEQ ID NO: 437616 - DNA, 943 bp, Homo sapiens
ggtagcgaggtctgggtggcgacttcggcacgagggaccactggaggggttcaaaggttcgcgtcccagtacgggaatgagcctctttgatctcttccggggctttttcggctttcctggacctcggagcttcagcccaggaggagggatacgtttccacgataacttcggctttgatgacctagtacgagatttcaatagcatcttcagcgatatgggggcctggaccttgccttcccatcctcctgaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaacagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactgtggtggacagtgagggccggacagagactacagtaacccgacacgaagcagatagcagtcctaggggtgatccagaatcaccaagacctccagccctggatgatgccttttccatcctggacttattcctgggacgttggttccggtcccggtagccttgttaaccctcagaggccttcaagtcctttccacctctcacccattgcccaccattaataagcttagcttctcttgccacctcaggggcttggatatgtggaatagtgaactggggccatgtcagtttgtcactcacccaaactgaccaataaaacctttatttatgct

SEQ ID NO: 437617 - DNA, 1248 bp, Homo sapiens
aaagataaagcctttcaaatttgaggaagaccttcggtcccgcctccatttcacgtccggcttaccgtcgtttacgacagtgtcaggatcgcgggcttgctttccggtagcgtgggctgacgcctcgctcaatttctcacagggctgcgcaggtttcccccgtctgcgaatggaccactggaggggttcaaaggttcgcgtcccagtacgggaatgagcctctttgatctcttccggggctttttcggctttcctggacctcggagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagcgatatgggggcctggaccttgccttcccatcctcctgcaaacacctgccacctttctgcagaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaacagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactgtggtggacagtgagggccggacagagactacagtaacccgacacgaagcagatagcagtcctaggggtgatccagaatcaccaagacctccagccctggatgatgccttttccatcctggacttattcctgggacgttggttccggtcccggtagccttgttaaccctcagaggccttcaagtcctttccacctctcacccattgcccaccattaataagcttagcttctcttgccacctcaggggcttggatatgtggaatagtgaactggggccatgtcagtttgtcactcacccaaactgaccaataaaacctttatttatgct

SEQ ID NO: 437618 - DNA, 1236 bp, Homo sapiens
aaagataaagcctttcaaatttgaggaagaccttcggtcccgcctccatttcacgtccggcttaccgtcgtttacgacagtgtcaggatcgcgggcttgctttccggtagcgtgggctgacgcctcgctcaatttctcacagggctgcgcaggtttcccccgtctgcgaatggaccactggaggggttcaaaggttcgcgtcccagtacgggaatgagcctctttgatctcttccggggctttttcggctttcctggacctcggagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctaaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaacagcaccagactggggctcccagaggccatttcataggtttgatgatgtatggcctatggacccccatcctagaaccagagaggacaatgtttcttcctgtacacttgtctccttttttcctttggactctttctctcctgcttcttcatctctctgctcttccagatcttgattcccaggtttcccaggagggtcttggcccggttctacagccccagcccaaatcctatttcaagagcatctctgtgaccaagatcactaaaccagatgggatagtggaggagcgccggactgtggtggacagtgagggccggacagagactacagtaacccgacacgaagcagatagcagtcctaggggtgatccagaatcaccaagacctccagccctggatgatgccttttccatcctggacttattcctgggacgttggttccggtcccggtagccttgttaaccctcagaggccttcaagtcctttccacctctcacccattgcccaccattaataagcttagcttctcttgccacctcaggggcttggatatgtggaatagtgaactggggccatgtcagtttgtcactcacccaaactgaccaataaaacctttatttatgct

SEQ ID NO: 437619 - DNA, 457 bp, Homo sapiens
gacggagtctcactctgtcgcccaggctggagtgcagtggtgtgatctcggctcactgcaagctctgcctcctgggttcacgccattctcctgccttggcctcccaaagtgctgagattacaggcatgagccactgtgcccagccctgattccttcttgatatcactacatctttgtcctctagggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagaggtctgtcctcatagtctaccttgagccaccacttttgtgttcctatctgcccacttctgcccattgagccttccagaaaccctctcccgtcccctataaa

SEQ ID NO: 437620 - DNA, 10114 bp, Homo sapiens
gcgggaagggtcctgggccccgggcggcggtcgccaggtctcagggccgggggtacccgagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtatacctggcccctctccgaagccccttgtccctttcttggggattgtggaggctgggtcagaggggagttaagggactgcaggcctggcagcaggacatgccttggctgaaccaagtcctgagagcagcatctctgtccccacggtgccttgtgtgggtccccgtccttggctttctgggtcctgggctgcccccagtgctccagaccttccccactggcaatccaggttatcatccatgtcctccagaggagcttcctcctccaggcctcagccctgttggcccaggtggagcaggagggaccactggaacatgtggtgcttgggaatgcctctcctgttgcattggtccctgaaggcctcagggcaggtatgtggtgtgtgggcgactccacaagacctgcctcccatcctggcagcccagcctgagaccgttgcattgaggcaggcaggagcggcagggtggctgctctccaggagcccaactgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtagagctgagggcatgagaggcagagtgcacagtggtcaagggtgcagctctgcagcacaggcagcctaggcctgcgtcccaacctgcctctcaccagctctgtgaccttgggcaagggatttatctgtctgtcccttagttttctcacctgtaaaaggaggataagtatatatatatatttcccagtgttgtgaagattaaaggagtttatcgatgtaggtcttaggatgagtcctggcatttaccaagggttggatatatgttattatcactattaagtgttgagggtccaggcatgctgggcaacagggaccccatctctacaaaaaagtttaaaaaattagccaggcgtggtggtgcacctgtcgtcttagctacttgggaggctgaggtgggaggatcacttgagcccagaagcttgaagctgcagtgagctaggatcgtgccactgcactccaacctgggtgagagagcgagaccctgtctcaagaaaaagaaaaatgcagagaaacaggagtcttggctactcctttagaggcagactcagaccctcctgcctcacagctttatctttgtatttgccccttactttatcttgtgccttgagaaattgctggggagagaggtatgtccactgggcagctgtacaggatggaggatatagggcgtttccactcccagcagccaggttccctcaccccaagctcacccactgttggggagattatctacaataacaccagaaacacattggggtggattgggggtatccttatgggttcttttcagggaaccattgctggacaaggcacaggagccacctccatttctgagctctgcaagggacaagaactagagccatcaggggctgggctcactgtggccccaccccaagccgtcagcctccagggatctacaccctgccttggctgctacagctttttcactccactgccctaggggagttcagcaacctaatgatctctatctctgaacatctcttcatcccatgctccaagtccagcaacctgcaccctggaaccaggagtggaccctacccgagctgtctgtattaatccccatcccccaccaccaatcttaaaaagccctctgtccccctaccctaaaccccagttaggtacccatgctgggcaggtcagttaacaatttatgcacaggtactagttttattgtattaccgttccagggtagctttgaaaaaagtatctcaaaaaggcaacaccaccgcgcccagccaaattaaattttttatagagatgaggtcatgctgttatgttgcccaggttggcctcatgagatcttgccttagcctcccaaagtgctgggattacagatgtgagacactgcacccaaaccccaccacttttttttttcctttttctttttttgagacagtcttactccgttgcccaggctggagtgtagtggcatgatctcagctcactgcaacctccgcctcccgggttcaagcaattctcctgcctcagcctcccgagtagctgggattacagaggcctgccaccacacccgactaattttcgtatttttagtagagacggggtttctccatgttggccaggctgttcttgaactcctgacctcaagtgctccacctgcgttggcttcccaaagtgctgggatacaggagtgagccactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaggccgaggtgggaggatcccttgaagccaggagtttgagacaagcctgggcaacaaagcaagaccctatctctaaaaaaaaaaaaaaaaaaaaatctaggagatgctctttaccctgcctggcctcaaactattaatagcttcctttgagcaacattatttattatgaactttcaaacacaaaaaagtagagagagtagaataacaaatccccatgagcccatcacccaacttcagtaattatcaattcatggccatcttgttcacccctgcctgcttccctgcttcccctcattctgcagaggttcttttcttttgagacagagtgttgctctgttgcccaggctggagtgcagtggtgcaacttcggctcactgcaacctccgcctcccaggttcaagtgattctcctgcttcagcctctcaagtagctgggattacagatgcccgccaccacacctggctaattttcgtatttttgttagagatggggtttcaccatgttggccaggctggtctcgaactcctgacctcaagtgatccgcccgccttggcctcccaaaatgctgggattacaggtgtgaaccacggtgcctggccactgtacaggttatttatagaagttggagagtgaagggttgagaaagccaaggggcagatgcgggtctggaggattttgtgcctaaggccctctctttgctcccagacagcatgaagtaacaatgaggcatccacctcttggttttgtggcctctgtggatgacgtctctcaccttgaaccagttcagagttggagtagcgcaggatcctgtcttcagaggaggggccgaagcgggttcctctgttgtcaagctctttggaggtgcctggctgctactactgtcccagagaggtgatgatgaatgatgggtgtgtccagtggcagtttgccccactgaggcaggggcttccactaggccctgacagagcccttccagcaggcagaaatccctgtgctaggcaagattcaaactccgtagcatgtctcctgctcccatctcttaggaatggagtccttcaggccttgagtcccacattttccatgatgctccattaagcagctgatagcacccccacctccagggaaagtgagttcagagtccttggtctaatgcatctgtgttgaaattgaggccttcccctgtgttcacctttctgctctttttcttttagcccaaggctatgaaggcctcattcggtgctgggcatggtcactcctagcattcctcactctgttgctaacagcaacagcaataataataagggttacaacttactccataccttactgtctgccaggcattaagctaagtgctttacatatattaagtcatttaatcctcataatgaccctatgaaagagataccatctcaacccaattgacagctggtttgcaagattaggagggatgaaggacccaggggacaatgcgagggaaaactctgaccccggggccccaggctggatgttctttatgcctgtgaaccacagcttatcacatgtctggagttagggaccccacttaaagtgagattttggctggaggtggtggatcatacctataatcccagcactttgggagaccaaggcagaaggactgcttgaggccaggagttcaaaaccagtgtaggtaacagctagaccctatctctacaaaaaatttaaaaattagctgggtgtggtggtatgtgcctcaagttccagctactcaggaggctgaggtgggaggatcacttgagcacaggagtttgaagttacagtgagctatgatggcaccactgcacttcagcctaggcaacagagggagaccctgtctttaaagtacatagaggtttttcacaccaacacatctctgcccagtgtgccaacatctgccacctgctataatagtactataacactcaatatgtaattaatgtagtctcagggatgttatgacaatatgattacaactatcacgtgtgtgcccagccaggctcaatgccccaggctgggcgaggtggggcaggggacacagcctaaaatgccaggcctcaggaagccatttggtttagcagacattgtttattaaaggagttacctatgccagatcgaaggcctaagatgattaagacactatgagtgccttcaagtggttggggacgttcatgattgtggtacagacaaataggctttcacatcattcttttatgtaatcatacaacagatatttgcacctacatgtgcagagcactgtgataggcctcagtgacacagaataatacggcaaagaccccacccgatgagccccctcccaccacccaccagtacagtagggggtggtttaatggagtgttcctggaatatgaagtgggggcaggcattaggggtggcaaagggacaagtgtttatctgatcagttatgtactgtttataataagtaaatcagcagagggggaataatacttagaacctatagagagtaaatctgacaagatgaaatgctgatgaaaatatggaggaaatgaaactctcatgggttttgcagggaatctaagtcagtgctgtgttgtgaatgtaggtgtaccctttgaattcatatgttgaatcctaacccccaaagcaatggcattaagaggtggggcctttggggctgggtatggtggctcatgactgtaatcccagcactttgggatgctggcagggggcagatcacttgaagccaggagtctgagatcagcctggccaacatggtgaaaccccatctgtactaaaaatacaaaaattagccaggtgtgatggcgtacatctgtaatttcagccactcgggaggctgagacaggagaatagcttgaacccagtaggtggagatttcagtgagccgagatcgtgccactgcactccagcctgggtgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggttatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctgcaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagatagaataacaaatccccatgactccatctacccatctggaccactat

SEQ ID NO: 437621 - DNA, 10171 bp, Homo sapiens
gcgggaagggtcctgggccccgggcggcggtcgccaggtctcagggccgggggtacccgagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtatacctggcccctctccgaagccccttgtccctttcttggggattgtggaggctgggtcagaggggagttaagggactgcaggcctggcagcaggacatgccttggctgaaccaagtcctgagagcagcatctctgtccccacggtgccttgtgtgggtccccgtccttggctttctgggtcctgggctgcccccagtgctccagaccttccccactggcaatccaggttatcatccatgtcctccagaggagcttcctcctccaggcctcagccctgttggcccaggtggagcaggagggaccactggaacatgtggtgcttgggaatgcctctcctgttgcattggtccctgaaggcctcagggcaggtatgtggtgtgtgggcgactccacaagacctgcctcccatcctggcagcccagcctgagaccgttgcattgaggcaggcaggagcggcagggtggctgctctccaggagcccaactgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtagagctgagggcatgagaggcagagtgcacagtggtcaagggtgcagctctgcagcacaggcagcctaggcctgcgtcccaacctgcctctcaccagctctgtgaccttgggcaagggatttatctgtctgtcccttagttttctcacctgtaaaaggaggataagtatatatatatatttcccagtgttgtgaagattaaaggagtttatcgatgtaggtcttaggatgagtcctggcatttaccaagggttggatatatgttattatcactattaagtgttgagggtccaggcatgctgggcaacagggaccccatctctacaaaaaagtttaaaaaattagccaggcgtggtggtgcacctgtcgtcttagctacttgggaggctgaggtgggaggatcacttgagcccagaagcttgaagctgcagtgagctaggatcgtgccactgcactccaacctgggtgagagagcgagaccctgtctcaagaaaaagaaaaatgcagagaaacaggagtcttggctactcctttagaggcagactcagaccctcctgcctcacagctttatctttgtatttgccccttactttatcttgtgccttgagaaattgctggggagagaggtatgtccactgggcagctgtacaggatggaggatatagggcgtttccactcccagcagccaggttccctcaccccaagctcacccactgttggggagattatctacaataacaccagaaacacattggggtggattgggggtatccttatgggttcttttcagggaaccattgctggacaaggcacaggagccacctccatttctgagctctgcaagggacaagaactagagccatcaggggctgggctcactgtggccccaccccaagccgtcagcctccagggatctacaccctgccttggctgctacagctttttcactccactgccctaggggagttcagcaacctaatgatctctatctctgaacatctcttcatcccatgctccaagtccagcaacctgcaccctggaaccaggagtggaccctacccgagctgtctgtattaatccccatcccccaccaccaatcttaaaaagccctctgtccccctaccctaaaccccagttaggtacccatgctgggcaggtcagttaacaatttatgcacaggtactagttttattgtattaccgttccagggtagctttgaaaaaagtatctcaaaaaggcaacaccaccgcgcccagccaaattaaattttttatagagatgaggtcatgctgttatgttgcccaggttggcctcatgagatcttgccttagcctcccaaagtgctgggattacagatgtgagacactgcacccaaaccccaccacttttttttttcctttttctttttttgagacagtcttactccgttgcccaggctggagtgtagtggcatgatctcagctcactgcaacctccgcctcccgggttcaagcaattctcctgcctcagcctcccgagtagctgggattacagaggcctgccaccacacccgactaattttcgtatttttagtagagacggggtttctccatgttggccaggctgttcttgaactcctgacctcaagtgctccacctgcgttggcttcccaaagtgctgggatacaggagtgagccactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaggccgaggtgggaggatcccttgaagccaggagtttgagacaagcctgggcaacaaagcaagaccctatctctaaaaaaaaaaaaaaaaaaaaatctaggagatgctctttaccctgcctggcctcaaactattaatagcttcctttgagcaacattatttattatgaactttcaaacacaaaaaagtagagagagtagaataacaaatccccatgagcccatcacccaacttcagtaattatcaattcatggccatcttgttcacccctgcctgcttccctgcttcccctcattctgcagaggttcttttcttttgagacagagtgttgctctgttgcccaggctggagtgcagtggtgcaacttcggctcactgcaacctccgcctcccaggttcaagtgattctcctgcttcagcctctcaagtagctgggattacagatgcccgccaccacacctggctaattttcgtatttttgttagagatggggtttcaccatgttggccaggctggtctcgaactcctgacctcaagtgatccgcccgccttggcctcccaaaatgctgggattacaggtgtgaaccacggtgcctggccactgtacaggttatttatagaagttggagagtgaagggttgagaaagccaaggggcagatgcgggtctggaggattttgtgcctaaggccctctctttgctcccagacagcatgaagtaacaatgaggcatccacctcttggttttgtggcctctgtggatgacgtctctcaccttgaaccagttcagagttggagtagcgcaggatcctgtcttcagaggaggggccgaagcgggttcctctgttgtcaagctctttggaggtgcctggctgctactactgtcccagagaggtgatgatgaatgatgggtgtgtccagtggcagtttgccccactgaggcaggggcttccactaggccctgacagagcccttccagcaggcagaaatccctgtgctaggcaagattcaaactccgtagcatgtctcctgctcccatctcttaggaatggagtccttcaggccttgagtcccacattttccatgatgctccattaagcagctgatagcacccccacctccagggaaagtgagttcagagtccttggtctaatgcatctgtgttgaaattgaggccttcccctgtgttcacctttctgctctttttcttttagcccaaggctatgaaggcctcattcggtgctgggcatggtcactcctagcattcctcactctgttgctaacagcaacagcaataataataagggttacaacttactccataccttactgtctgccaggcattaagctaagtgctttacatatattaagtcatttaatcctcataatgaccctatgaaagagataccatctcaacccaattgacagctggtttgcaagattaggagggatgaaggacccaggggacaatgcgagggaaaactctgaccccggggccccaggctggatgttctttatgcctgtgaaccacagcttatcacatgtctggagttagggaccccacttaaagtgagattttggctggaggtggtggatcatacctataatcccagcactttgggagaccaaggcagaaggactgcttgaggccaggagttcaaaaccagtgtaggtaacagctagaccctatctctacaaaaaatttaaaaattagctgggtgtggtggtatgtgcctcaagttccagctactcaggaggctgaggtgggaggatcacttgagcacaggagtttgaagttacagtgagctatgatggcaccactgcacttcagcctaggcaacagagggagaccctgtctttaaagtacatagaggtttttcacaccaacacatctctgcccagtgtgccaacatctgccacctgctataatagtactataacactcaatatgtaattaatgtagtctcagggatgttatgacaatatgattacaactatcacgtgtgtgcccagccaggctcaatgccccaggctgggcgaggtggggcaggggacacagcctaaaatgccaggcctcaggaagccatttggtttagcagacattgtttattaaaggagttacctatgccagatcgaaggcctaagatgattaagacactatgagtgccttcaagtggttggggacgttcatgattgtggtacagacaaataggctttcacatcattcttttatgtaatcatacaacagatatttgcacctacatgtgcagagcactgtgataggcctcagtgacacagaataatacggcaaagaccccacccgatgagccccctcccaccacccaccagtacagtagggggtggtttaatggagtgttcctggaatatgaagtgggggcaggcattaggggtggcaaagggacaagtgtttatctgatcagttatgtactgtttataataagtaaatcagcagagggggaataatacttagaacctatagagagtaaatctgacaagatgaaatgctgatgaaaatatggaggaaatgaaactctcatgggttttgcagggaatctaagtcagtgctgtgttgtgaatgtaggtgtaccctttgaattcatatgttgaatcctaacccccaaagcaatggcattaagaggtggggcctttggggctgggtatggtggctcatgactgtaatcccagcactttgggatgctggcagggggcagatcacttgaagccaggagtctgagatcagcctggccaacatggtgaaaccccatctgtactaaaaatacaaaaattagccaggtgtgatggcgtacatctgtaatttcagccactcgggaggctgagacaggagaatagcttgaacccagtaggtggagatttcagtgagccgagatcgtgccactgcactccagcctgggtgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggttatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctaaaaaaaaaatcagaaactggattttttttttcttaagcagggcttaatttgtgttttcaaatttgattcagaagtagtcccagctcataggtgttcatactgttacatccagaacattgtgtcaggctctctgtcagtttcatgtacatatggtatagaaaccatggagttaggcacttcctggatttttatgagaaattctgttttagctgttgaagtacacttttacacaagcggcctaag

SEQ ID NO: 437622 - DNA, 10094 bp, Homo sapiens
  misc_feature (4052)..(4052): n is a, c, g, or t
  misc_feature (4117)..(4118): n is a, c, g, or t
gcgggaagggtcctgggccccgggcggcggtcgccaggtctcagggccgggggtacccgagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtatacctggcccctctccgaagccccttgtccctttcttggggattgtggaggctgggtcagaggggagttaagggactgcaggcctggcagcaggacatgccttggctgaaccaagtcctgagagcagcatctctgtccccacggtgccttgtgtgggtccccgtccttggctttctgggtcctgggctgcccccagtgctccagaccttccccactggcaatccaggttatcatccatgtcctccagaggagcttcctcctccaggcctcagccctgttggcccaggtggagcaggagggaccactggaacatgtggtgcttgggaatgcctctcctgttgcattggtccctgaaggcctcagggcaggtatgtggtgtgtgggcgactccacaagacctgcctcccatcctggcagcccagcctgagaccgttgcattgaggcaggcaggagcggcagggtggctgctctccaggagcccaactgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtagagctgagggcatgagaggcagagtgcacagtggtcaagggtgcagctctgcagcacaggcagcctaggcctgcgtcccaacctgcctctcaccagctctgtgaccttgggcaagggatttatctgtctgtcccttagttttctcacctgtaaaaggaggataagtatatatatatatttcccagtgttgtgaagattaaaggagtttatcgatgtaggtcttaggatgagtcctggcatttaccaagggttggatatatgttattatcactattaagtgttgagggtccaggcatgctgggcaacagggaccccatctctacaaaaaagtttaaaaaattagccaggcgtggtggtgcacctgtcgtcttagctacttgggaggctgaggtgggaggatcacttgagcccagaagcttgaagctgcagtgagctaggatcgtgccactgcactccaacctgggtgagagagcgagaccctgtctcaagaaaaagaaaaatgcagagaaacaggagtcttggctactcctttagaggcagactcagaccctcctgcctcacagctttatctttgtatttgccccttactttatcttgtgccttgagaaattgctggggagagaggtatgtccactgggcagctgtacaggatggaggatatagggcgtttccactcccagcagccaggttccctcaccccaagctcacccactgttggggagattatctacaataacaccagaaacacattggggtggattgggggtatccttatgggttcttttcagggaaccattgctggacaaggcacaggagccacctccatttctgagctctgcaagggacaagaactagagccatcaggggctgggctcactgtggccccaccccaagccgtcagcctccagggatctacaccctgccttggctgctacagctttttcactccactgccctaggggagttcagcaacctaatgatctctatctctgaacatctcttcatcccatgctccaagtccagcaacctgcaccctggaaccaggagtggaccctacccgagctgtctgtattaatccccatcccccaccaccaatcttaaaaagccctctgtccccctaccctaaaccccagttaggtacccatgctgggcaggtcagttaacaatttatgcacaggtactagttttattgtattaccgttccagggtagctttgaaaaaagtatctcaaaaaggcaacatgggccgagcgcagtggctcgcgcctgtggtcccagcactttgggaggccaaggtgggcagatcgcctgaggtctggagttcaagaccagcctggccnacggggtgaaaccccgtctctacaaaaataagaaaattggccaggtgtggtggcagacgtctgtnntcccagctattcaggaggctgaggcacgagaattccatgaacaacctccgcctcccgggttcaagcaattctcctgcctcagcctcccgagtagctgggattacagaggcctgccaccacacccgactaattttcgtatttttagtagagacggggtttctccatgttggccaggctgttcttgaactcctgacctcaagtgctccacctgcgttggcttcccaaagtgctgggatacaggagtgagccactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaggccgaggtgggaggatcccttgaagccaggagtttgagacaagcctgggcaacaaagcaagaccctatctctaaaaaaaaaaaaaaaaaaaaatctaggagatgctctttaccctgcctggcctcaaactattaatagcttcctttgagcaacattatttattatgaactttcaaacacaaaaaagtagagagagtagaataacaaatccccatgagcccatcacccaacttcagtaattatcaattcatggccatcttgttcacccctgcctgcttccctgcttcccctcattctgcagaggttcttttcttttgagacagagtgttgctctgttgcccaggctggagtgcagtggtgcaacttcggctcactgcaacctccgcctcccaggttcaagtgattctcctgcttcagcctctcaagtagctgggattacagatgcccgccaccacacctggctaattttcgtatttttgttagagatggggtttcaccatgttggccaggctggtctcgaactcctgacctcaagtgatccgcccgccttggcctcccaaaatgctgggattacaggtgtgaaccacggtgcctggccactgtacaggttatttatagaagttggagagtgaagggttgagaaagccaaggggcagatgcgggtctggaggattttgtgcctaaggccctctctttgctcccagacagcatgaagtaacaatgaggcatccacctcttggttttgtggcctctgtggatgacgtctctcaccttgaaccagttcagagttggagtagcgcaggatcctgtcttcagaggaggggccgaagcgggttcctctgttgtcaagctctttggaggtgcctggctgctactactgtcccagagaggtgatgatgaatgatgggtgtgtccagtggcagtttgccccactgaggcaggggcttccactaggccctgacagagcccttccagcaggcagaaatccctgtgctaggcaagattcaaactccgtagcatgtctcctgctcccatctcttaggaatggagtccttcaggccttgagtcccacattttccatgatgctccattaagcagctgatagcacccccacctccagggaaagtgagttcagagtccttggtctaatgcatctgtgttgaaattgaggccttcccctgtgttcacctttctgctctttttcttttagcccaaggctatgaaggcctcattcggtgctgggcatggtcactcctagcattcctcactctgttgctaacagcaacagcaataataataagggttacaacttactccataccttactgtctgccaggcattaagctaagtgctttacatatattaagtcatttaatcctcataatgaccctatgaaagagataccatctcaacccaattgacagctggtttgcaagattaggagggatgaaggacccaggggacaatgcgagggaaaactctgaccccggggccccaggctggatgttctttatgcctgtgaaccacagcttatcacatgtctggagttagggaccccacttaaagtgagattttggctggaggtggtggatcatacctataatcccagcactttgggagaccaaggcagaaggactgcttgaggccaggagttcaaaaccagtgtaggtaacagctagaccctatctctacaaaaaatttaaaaattagctgggtgtggtggtatgtgcctcaagttccagctactcaggaggctgaggtgggaggatcacttgagcacaggagtttgaagttacagtgagctatgatggcaccactgcacttcagcctaggcaacagagggagaccctgtctttaaagtacatagaggtttttcacaccaacacatctctgcccagtgtgccaacatctgccacctgctataatagtactataacactcaatatgtaattaatgtagtctcagggatgttatgacaatatgattacaactatcacgtgtgtgcccagccaggctcaatgccccaggctgggcgaggtggggcaggggacacagcctaaaatgccaggcctcaggaagccatttggtttagcagacattgtttattaaaggagttacctatgccagatcgaaggcctaagatgattaagacactatgagtgccttcaagtggttggggacgttcatgattgtggtacagacaaataggctttcacatcattcttttatgtaatcatacaacagatatttgcacctacatgtgcagagcactgtgataggcctcagtgacacagaataatacggcaaagaccccacccgatgagccccctcccaccacccaccagtacagtagggggtggtttaatggagtgttcctggaatatgaagtgggggcaggcattaggggtggcaaagggacaagtgtttatctgatcagttatgtactgtttataataagtaaatcagcagagggggaataatacttagaacctatagagagtaaatctgacaagatgaaatgctgatgaaaatatggaggaaatgaaactctcatgggttttgcagggaatctaagtcagtgctgtgttgtgaatgtaggtgtaccctttgaattcatatgttgaatcctaacccccaaagcaatggcattaagaggtggggcctttggggctgggtatggtggctcatgactgtaatcccagcactttgggatgctggcagggggcagatcacttgaagccaggagtctgagatcagcctggccaacatggtgaaaccccatctgtactaaaaatacaaaaattagccaggtgtgatggcgtacatctgtaatttcagccactcgggaggctgagacaggagaatagcttgaacccagtaggtggagatttcagtgagccgagatcgtgccactgcactccagcctgggtgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggttatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctgcaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagatagaataacaaatccccatgactccatctacccatctggaccactat

SEQ ID NO: 437623 - DNA, 10179 bp, Homo sapiens
gcgggaagggtcctgggccccgggcggcggtcgccaggtctcagggccgggggtacccgagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtatacctggcccctctccgaagccccttgtccctttcttggggattgtggaggctgggtcagaggggagttaagggactgcaggcctggcagcaggacatgccttggctgaaccaagtcctgagagcagcatctctgtccccacggtgccttgtgtgggtccccgtccttggctttctgggtcctgggctgcccccagtgctccagaccttccccactggcaatccaggttatcatccatgtcctccagaggagcttcctcctccaggcctcagccctgttggcccaggtggagcaggagggaccactggaacatgtggtgcttgggaatgcctctcctgttgcattggtccctgaaggcctcagggcaggtatgtggtgtgtgggcgactccacaagacctgcctcccatcctggcagcccagcctgagaccgttgcattgaggcaggcaggagcggcagggtggctgctctccaggagcccaactgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtagagctgagggcatgagaggcagagtgcacagtggtcaagggtgcagctctgcagcacaggcagcctaggcctgcgtcccaacctgcctctcaccagctctgtgaccttgggcaagggatttatctgtctgtcccttagttttctcacctgtaaaaggaggataagtatatatatatatttcccagtgttgtgaagattaaaggagtttatcgatgtaggtcttaggatgagtcctggcatttaccaagggttggatatatgttattatcactattaagtgttgagggtccaggcatgctgggcaacagggaccccatctctacaaaaaagtttaaaaaattagccaggcgtggtggtgcacctgtcgtcttagctacttgggaggctgaggtgggaggatcacttgagcccagaagcttgaagctgcagtgagctaggatcgtgccactgcactccaacctgggtgagagagcgagaccctgtctcaagaaaaagaaaaatgcagagaaacaggagtcttggctactcctttagaggcagactcagaccctcctgcctcacagctttatctttgtatttgccccttactttatcttgtgccttgagaaattgctggggagagaggtatgtccactgggcagctgtacaggatggaggatatagggcgtttccactcccagcagccaggttccctcaccccaagctcacccactgttggggagattatctacaataacaccagaaacacattggggtggattgggggtatccttatgggttcttttcagggaaccattgctggacaaggcacaggagccacctccatttctgagctctgcaagggacaagaactagagccatcaggggctgggctcactgtggccccaccccaagccgtcagcctccagggatctacaccctgccttggctgctacagctttttcactccactgccctaggggagttcagcaacctaatgatctctatctctgaacatctcttcatcccatgctccaagtccagcaacctgcaccctggaaccaggagtggaccctacccgagctgtctgtattaatccccatcccccaccaccaatcttaaaaagccctctgtccccctaccctaaaccccagttaggtacccatgctgggcaggtcagttaacaatttatgcacaggtactagttttattgtattaccgttccagggtagctttgaaaaaagtatctcaaaaaggcaacaccaccgcgcccagccaaattaaattttttatagagatgaggtcatgctgttatgttgcccaggttggcctcatgagatcttgccttagcctcccaaagtgctgggattacagatgtgagacactgcacccaaaccccaccacttttttttttcctttttctttttttgagacagtcttactccgttgcccaggctggagtgtagtggcatgatctcagctcactgcaacctccgcctcccgggttcaagcaattctcctgcctcagcctcccgagtagctgggattacagaggcctgccaccacacccgactaattttcgtatttttagtagagacggggtttctccatgttggccaggctgttcttgaactcctgacctcaagtgctccacctgcgttggcttcccaaagtgctgggatacaggagtgagccactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaggccgaggtgggaggatcccttgaagccaggagtttgagacaagcctgggcaacaaagcaagaccctatctctaaaaaaaaaaaaaaaaaaaaatctaggagatgctctttaccctgcctggcctcaaactattaatagcttcctttgagcaacattatttattatgaactttcaaacacaaaaaagtagagagagtagaataacaaatccccatgagcccatcacccaacttcagtaattatcaattcatggccatcttgttcacccctgcctgcttccctgcttcccctcattctgcagaggttcttttcttttgagacagagtgttgctctgttgcccaggctggagtgcagtggtgcaacttcggctcactgcaacctccgcctcccaggttcaagtgattctcctgcttcagcctctcaagtagctgggattacagatgcccgccaccacacctggctaattttcgtatttttgttagagatggggtttcaccatgttggccaggctggtctcgaactcctgacctcaagtgatccgcccgccttggcctcccaaaatgctgggattacaggtgtgaaccacggtgcctggccactgtacaggttatttatagaagttggagagtgaagggttgagaaagccaaggggcagatgcgggtctggaggattttgtgcctaaggccctctctttgctcccagacagcatgaagtaacaatgaggcatccacctcttggttttgtggcctctgtggatgacgtctctcaccttgaaccagttcagagttggagtagcgcaggatcctgtcttcagaggaggggccgaagcgggttcctctgttgtcaagctctttggaggtgcctggctgctactactgtcccagagaggtgatgatgaatgatgggtgtgtccagtggcagtttgccccactgaggcaggggcttccactaggccctgacagagcccttccagcaggcagaaatccctgtgctaggcaagattcaaactccgtagcatgtctcctgctcccatctcttaggaatggagtccttcaggccttgagtcccacattttccatgatgctccattaagcagctgatagcacccccacctccagggaaagtgagttcagagtccttggtctaatgcatctgtgttgaaattgaggccttcccctgtgttcacctttctgctctttttcttttagcccaaggctatgaaggcctcattcggtgctgggcatggtcactcctagcattcctcactctgttgctaacagcaacagcaataataataagggttacaacttactccataccttactgtctgccaggcattaagctaagtgctttacatatattaagtcatttaatcctcataatgaccctatgaaagagataccatctcaacccaattgacagctggtttgcaagattaggagggatgaaggacccaggggacaatgcgagggaaaactctgaccccggggccccaggctggatgttctttatgcctgtgaaccacagcttatcacatgtctggagttagggaccccacttaaagtgagattttggctggaggtggtggatcatacctataatcccagcactttgggagaccaaggcagaaggactgcttgaggccaggagttcaaaaccagtgtaggtaacagctagaccctatctctacaaaaaatttaaaaattagctgggtgtggtggtatgtgcctcaagttccagctactcaggaggctgaggtgggaggatcacttgagcacaggagtttgaagttacagtgagctatgatggcaccactgcacttcagcctaggcaacagagggagaccctgtctttaaagtacatagaggtttttcacaccaacacatctctgcccagtgtgccaacatctgccacctgctataatagtactataacactcaatatgtaattaatgtagtctcagggatgttatgacaatatgattacaactatcacgtgtgtgcccagccaggctcaatgccccaggctgggcgaggtggggcaggggacacagcctaaaatgccaggcctcaggaagccatttggtttagcagacattgtttattaaaggagttacctatgccagatcgaaggcctaagatgattaagacactatgagtgccttcaagtggttggggacgttcatgattgtggtacagacaaataggctttcacatcattcttttatgtaatcatacaacagatatttgcacctacatgtgcagagcactgtgataggcctcagtgacacagaataatacggcaaagaccccacccgatgagccccctcccaccacccaccagtacagtagggggtggtttaatggagtgttcctggaatatgaagtgggggcaggcattaggggtggcaaagggacaagtgtttatctgatcagttatgtactgtttataataagtaaatcagcagagggggaataatacttagaacctatagagagtaaatctgacaagatgaaatgctgatgaaaatatggaggaaatgaaactctcatgggttttgcagggaatctaagtcagtgctgtgttgtgaatgtaggtgtaccctttgaattcatatgttgaatcctaacccccaaagcaatggcattaagaggtggggcctttggggctgggtatggtggctcatgactgtaatcccagcactttgggatgctggcagggggcagatcacttgaagccaggagtctgagatcagcctggccaacatggtgaaaccccatctgtactaaaaatacaaaaattagccaggtgtgatggcgtacatctgtaatttcagccactcgggaggctgagacaggagaatagcttgaacccagtaggtggagatttcagtgagccgagatcgtgccactgcactccagcctgggtgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggttatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactggagtacagtggtgagatcatagcttactgtactccagcctgggtgacagagcgagacccagactcaaaaaataaaaataaaaaccctgaatatcttccttctgcaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagatagaataacaaatccccatgactccatctacccatctggaccactat

SEQ ID NO: 437624 - DNA, 9682 bp, Homo sapiens
gcgggaagggtcctgggccccgggcggcggtcgccaggtctcagggccgggggtacccgagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtatacctggcccctctccgaagccccttgtccctttcttggggattgtggaggctgggtcagaggggagttaagggactgcaggcctggcagcaggacatgccttggctgaaccaagtcctgagagcagcatctctgtccccacggtgccttgtgtgggtccccgtccttggctttctgggtcctgggctgcccccagtgctccagaccttccccactggcaatccaggttatcatccatgtcctccagaggagcttcctcctccaggcctcagccctgttggcccaggtggagcaggagggaccactggaacatgtggtgcttgggaatgcctctcctgttgcattggtccctgaaggcctcagggcaggtatgtggtgtgtgggcgactccacaagacctgcctcccatcctggcagcccagcctgagaccgttgcattgaggcaggcaggagcggcagggtggctgctctccaggagcccaactgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtagagctgagggcatgagaggcagagtgcacagtggtcaagggtgcagctctgcagcacaggcagcctaggcctgcgtcccaacctgcctctcaccagctctgtgaccttgggcaagggatttatctgtctgtcccttagttttctcacctgtaaaaggaggataagtatatatatatatttcccagtgttgtgaagattaaaggagtttatcgatgtaggtcttaggatgagtcctggcatttaccaagggttggatatatgttattatcactattaagtgttgagggtccaggcatgctgggcaacagggaccccatctctacaaaaaagtttaaaaaattagccaggcgtggtggtgcacctgtcgtcttagctacttgggaggctgaggtgggaggatcacttgagcccagaagcttgaagctgcagtgagctaggatcgtgccactgcactccaacctgggtgagagagcgagaccctgtctcaagaaaaagaaaaatgcagagaaacaggagtcttggctactcctttagaggcagactcagaccctcctgcctcacagctttatctttgtatttgccccttactttatcttgtgccttgagaaattgctggggagagaggtatgtccactgggcagctgtacaggatggaggatatagggcgtttccactcccagcagccaggttccctcaccccaagctcacccactgttggggagattatctacaataacaccagaaacacattggggtggattgggggtatccttatgggttcttttcagggaaccattgctggacaaggcacaggagccacctccatttctgagctctgcaagggacaagaactagagccatcaggggctgggctcactgtggccccaccccaagccgtcagcctccagggatctacaccctgccttggctgctacagctttttcactccactgccctaggggagttcagcaacctaatgatctctatctctgaacatctcttcatcccatgctccaagtccagcaacctgcaccctggaaccaggagtggaccctacccgagctgtctgtattaatccccatcccccaccaccaatcttaaaaagccctctgtccccctaccctaaaccccagttaggtacccatgctgggcaggtcagttaacaatttatgcacaggtactagttttattgtattaccgttccagggtagctttgaaaaaagtatctcaaaaaggcaacacactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaggccgaggtgggaggatcccttgaagccaggagtttgagacaagcctgggcaacaaagcaagaccctatctctaaaaaaaaaaaaaaaaaaaaatctaggagatgctctttaccctgcctggcctcaaactattaatagcttcctttgagcaacattatttattatgaactttcaaacacaaaaaagtagagagagtagaataacaaatccccatgagcccatcacccaacttcagtaattatcaattcatggccatcttgttcacccctgcctgcttccctgcttcccctcattctgcagaggttcttttcttttgagacagagtgttgctctgttgcccaggctggagtgcagtggtgcaacttcggctcactgcaacctccgcctcccaggttcaagtgattctcctgcttcagcctctcaagtagctgggattacagatgcccgccaccacacctggctaattttcgtatttttgttagagatggggtttcaccatgttggccaggctggtctcgaactcctgacctcaagtgatccgcccgccttggcctcccaaaatgctgggattacaggtgtgaaccacggtgcctggccactgtacaggttatttatagaagttggagagtgaagggttgagaaagccaaggggcagatgcgggtctggaggattttgtgcctaaggccctctctttgctcccagacagcatgaagtaacaatgaggcatccacctcttggttttgtggcctctgtggatgacgtctctcaccttgaaccagttcagagttggagtagcgcaggatcctgtcttcagaggaggggccgaagcgggttcctctgttgtcaagctctttggaggtgcctggctgctactactgtcccagagaggtgatgatgaatgatgggtgtgtccagtggcagtttgccccactgaggcaggggcttccactaggccctgacagagcccttccagcaggcagaaatccctgtgctaggcaagattcaaactccgtagcatgtctcctgctcccatctcttaggaatggagtccttcaggccttgagtcccacattttccatgatgctccattaagcagctgatagcacccccacctccagggaaagtgagttcagagtccttggtctaatgcatctgtgttgaaattgaggccttcccctgtgttcacctttctgctctttttcttttagcccaaggctatgaaggcctcattcggtgctgggcatggtcactcctagcattcctcactctgttgctaacagcaacagcaataataataagggttacaacttactccataccttactgtctgccaggcattaagctaagtgctttacatatattaagtcatttaatcctcataatgaccctatgaaagagataccatctcaacccaattgacagctggtttgcaagattaggagggatgaaggacccaggggacaatgcgagggaaaactctgaccccggggccccaggctggatgttctttatgcctgtgaaccacagcttatcacatgtctggagttagggaccccacttaaagtgagattttggctggaggtggtggatcatacctataatcccagcactttgggagaccaaggcagaaggactgcttgaggccaggagttcaaaaccagtgtaggtaacagctagaccctatctctacaaaaaatttaaaaattagctgggtgtggtggtatgtgcctcaagttccagctactcaggaggctgaggtgggaggatcacttgagcacaggagtttgaagttacagtgagctatgatggcaccactgcacttcagcctaggcaacagagggagaccctgtctttaaagtacatagaggtttttcacaccaacacatctctgcccagtgtgccaacatctgccacctgctataatagtactataacactcaatatgtaattaatgtagtctcagggatgttatgacaatatgattacaactatcacgtgtgtgcccagccaggctcaatgccccaggctgggcgaggtggggcaggggacacagcctaaaatgccaggcctcaggaagccatttggtttagcagacattgtttattaaaggagttacctatgccagatcgaaggcctaagatgattaagacactatgagtgccttcaagtggttggggacgttcatgattgtggtacagacaaataggctttcacatcattcttttatgtaatcatacaacagatatttgcacctacatgtgcagagcactgtgataggcctcagtgacacagaataatacggcaaagaccccacccgatgagccccctcccaccacccaccagtacagtagggggtggtttaatggagtgttcctggaatatgaagtgggggcaggcattaggggtggcaaagggacaagtgtttatctgatcagttatgtactgtttataataagtaaatcagcagagggggaataatacttagaacctatagagagtaaatctgacaagatgaaatgctgatgaaaatatggaggaaatgaaactctcatgggttttgcagggaatctaagtcagtgctgtgttgtgaatgtaggtgtaccctttgaattcatatgttgaatcctaacccccaaagcaatggcattaagaggtggggcctttggggctgggtatggtggctcatgactgtaatcccagcactttgggatgctggcagggggcagatcacttgaagccaggagtctgagatcagcctggccaacatggtgaaaccccatctgtactaaaaatacaaaaattagccaggtgtgatggcgtacatctgtaatttcagccactcgggaggctgagacaggagaatagcttgaacccagtaggtggagatttcagtgagccgagatcgtgccactgcactccagcctgggtgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggttatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctgcaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagatagaataacaaatccccatgactccatctacccatctggaccactat

SEQ ID NO: 437625 - DNA, 9887 bp, Homo sapiens
gcgggaagggtcctgggccccgggcggcggtcgccaggtctcagggccgggggtacccgagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtatacctggcccctctccgaagccccttgtccctttcttggggattgtggaggctgggtcagaggggagttaagggactgcaggcctggcagcaggacatgccttggctgaaccaagtcctgagagcagcatctctgtccccacggtgccttgtgtgggtccccgtccttggctttctgggtcctgggctgcccccagtgctccagaccttccccactggcaatccaggttatcatccatgtcctccagaggagcttcctcctccaggcctcagccctgttggcccaggtggagcaggagggaccactggaacatgtggtgcttgggaatgcctctcctgttgcattggtccctgaaggcctcagggcaggtatgtggtgtgtgggcgactccacaagacctgcctcccatcctggcagcccagcctgagaccgttgcattgaggcaggcaggagcggcagggtggctgctctccaggagcccaactgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtagagctgagggcatgagaggcagagtgcacagtggtcaagggtgcagctctgcagcacaggcagcctaggcctgcgtcccaacctgcctctcaccagctctgtgaccttgggcaagggatttatctgtctgtcccttagttttctcacctgtaaaaggaggataagtatatatatatatttcccagtgttgtgaagattaaaggagtttatcgatgtaggtcttaggatgagtcctggcatttaccaagggttggatatatgttattatcactattaagtgttgagggtccaggcatgctgggcaacagggaccccatctctacaaaaaagtttaaaaaattagccaggcgtggtggtgcacctgtcgtcttagctacttgggaggctgaggtgggaggatcacttgagcccagaagcttgaagctgcagtgagctaggatcgtgccactgcactccaacctgggtgagagagcgagaccctgtctcaagaaaaagaaaaatgcagagaaacaggagtcttggctactcctttagaggcagactcagaccctcctgcctcacagctttatctttgtatttgccccttactttatcttgtgccttgagaaattgctggggagagaggtatgtccactgggcagctgtacaggatggaggatatagggcgtttccactcccagcagccaggttccctcaccccaagctcacccactgttggggagattatctacaataacaccagaaacacattggggtggattgggggtatccttatgggttcttttcagggaaccattgctggacaaggcacaggagccacctccatttctgagctctgcaagggacaagaactagagccatcaggggctgggctcactgtggccccaccccaagccgtcagcctccagggatctacaccctgccttggctgctacagctttttcactccactgccctaggggagttcagcaacctaatgatctctatctctgaacatctcttcatcccatgctccaagtccagcaacctgcaccctggaaccaggagtggaccctacccgagctgtctgtattaatccccatcccccaccaccaatcttaaaaagccctctgtccccctaccctaaaccccagttaggtacccatgctgggcaggtcagttaacaatttatgcacaggtactagttttattgtattaccgttccagggtagctttgaaaaaagtatctcaaaaaggcaacaccaccgcgcccagccaaattaaattttttatagagatgaggtcatgctgttatgttgcccaggttggcctcatgagatcttgccttagcctcccaaagtgctgggattacagatgtgagacactgcacccaaaccccaccacttttttttttcctttttctttttttgagacagtcttactccgttgcccaggctggagtgtagtggcatgatctcagctcactgcaacctccgcctcccgggttcaagcaattctcctgcctcagcctcccgagtagctgggattacagaggcctgccaccacacccgactaattttcgtatttttagtagagacggggtttctccatgttggccaggctgttcttgaactcctgacctcaagtgctccacctgcgttggcttcccaaagtgctgggatacaggagtgagccactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaggccgaggtgggaggatcccttgaagccaggagtttgagacaagcctgggcaacaaagcaagaccctatctctaaaaaaaaaaaaaaaaaaaaatctaggagatgctctttaccctgcctggcctcaaactattaatagcttcctttgagcaacattatttattatgaactttcaaacacaaaaaagtagagagagtagaataacaaatccccatgagcccatcacccaacttcagtaattatcaattcatggccatcttgttcacccctgcctgcttccctgcttcccctcattctgcagaggttcttttcttttgagacagagtgttgctctgttgcccaggctggagtgcagtggtgcaacttcggctcactgcaacctccgcctcccaggttcaagtgattctcctgcttcagcctctcaagtagctgggattacagatgcccgccaccacacctggctaattttcgtatttttgttagagatggggtttcaccatgttggccaggctggtctcgaactcctgacctcaagtgatccgcccgccttggcctcccaaaatgctgggattacaggtgtgaaccacggtgcctggccactgtacaggttatttatagaagttggagagtgaagggttgagaaagccaaggggcagatgcgggtctggaggattttgtgcctaaggccctctctttgctcccagacagcatgaagtaacaatgaggcatccacctcttggttttgtggcctctgtggatgacgtctctcaccttgaaccagttcagagttggagtagcgcaggatcctgtcttcagaggaggggccgaagcgggttcctctgttgtcaagctctttggaggtgcctggctgctactactgtcccagagaggtgatgatgaatgatgggtgtgtccagtggcagtttgccccactgaggcaggggcttccactaggccctgacagagcccttccagcaggcagaaatccctgtgctaggcaagattcaaactccgtagcatgtctcctgctcccatctcttaggaatggagtccttcaggccttgagtcccacattttccatgatgctccattaagcagctgatagcacccccacctccagggaaagtgagttcagagtccttggtctaatgcatctgtgttgaaattgaggccttcccctgtgttcacctttctgctctttttcttttagcccaaggctatgaaggcctcattcggtgctgggcatggtcactcctagcattcctcactctgttgctaacagcaacagcaataataataagggttacaacttactccataccttactgtctgccaggcattaagctaagtgctttacatatattaagtcatttaatcctcataatgaccctatgaaagagataccatctcaacccaattgacagctggtttgcaagattaggagggatgaaggacccaggggacaatgcgagggaaaactctgaccccggggccccaggctggatgttctttatgcctgtgaaccacagcttatcacatgtctggagttagggaccccacttaaagtgagattttggctggaggtggtggatcatacctataatcccagcactttgggagaccaaggcagaaggactgcttgaggccaggagttcaaaaccagtgtaggtaacagctagaccctatctctacaaaaaatttaaaaattagctgggtgtggtggtatgtgcctcaagttccagctactcaggaggctgaggtgggaggatcacttgagcacaggagtttgaagttacagtgagctatgatggcaccactgcacttcagcctaggcaacagagggagaccctgtctttaaagtacatagaggtttttcacaccaacacatctctgcccagtgtgccaacatctgccacctgctataatagtactataacactcaatatgtaattaatgtagtctcagggatgttatgacaatatgattacaactatcacgtgtgtgcccagccaggctcaatgccccaggctgggcgaggtggggcaggggacacagcctaaaatgccaggcctcaggaagccatttggtttagcagacattgtttattaaaggagttacctatgccagatcgaaggcctaagatgattaagacactatgagtgccttcaagtggttggggacgttcatgattgtggtacagacaaataggctttcacatcattcttttatgtaatcatacaacagatatttgcacctacatgtgcagagcactgtgataggcctcagtgacacagaataatacggcaaagaccccacccgatgagccccctcccaccacccaccagtacagtagggggtggtttaatggagtgttcctggaatatgaagtgggggcaggcattaggggtggcaaagggacaagtgtttatctgatcagttatgtactgtttataataagtaaatcagcagagggggaataatacttagaacctatagagagtaaatctgacaagatgaaatgctgatgaaaatatggaggaaatgaaactctcatgggttttgcagggaatctaagtcagtgctgtgttgtgaatgtaggtgtaccctttgaattcatatgttgaatcctaacccccaaagcaatggcattaagaggtggggcctttggggctgggtatggtggctcatgactgtaatcccagcactttgggatgctggcagggggcagatcacttgaagccaggagtctgagatcagcctggccaacatggtgaaaccccatctgtactaaaaatacaaaaattagccaggtgtgatggcgtacatctgtaatttcagccactcgggaggctgagacaggagaatagcttgaacccagtaggtggagatttcagtgagccgagatcgtgccactgcactccagcctgggtgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctgcaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagatagaataacaaatccccatgactccatctacccatctggaccactat

SEQ ID NO: 437626 - DNA, 8877 bp, Homo sapiens
gcgggaagggtcctgggccccgggcggcggtcgccaggtctcagggccgggggtacccgagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtatacctggcccctctccgaagccccttgtccctttcttggggattgtggaggctgggtcagaggggagttaagggactgcaggcctggcagcaggacatgccttggctgaaccaagtcctgagagcagcatctctgtccccacggtgccttgtgtgggtccccgtccttggctttctgggtcctgggctgcccccagtgctccagaccttccccactggcaatccaggttatcatccatgtcctccagaggagcttcctcctccaggcctcagccctgttggcccaggtggagcaggagggaccactggaacatgtggtgcttgggaatgcctctcctgttgcattggtccctgaaggcctcagggcaggtatgtggtgtgtgggcgactccacaagacctgcctcccatcctggcagcccagcctgagaccgttgcattgaggcaggcaggagcggcagggtggctgctctccaggagcccaactgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtagagctgagggcatgagaggcagagtgcacagtggtcaagggtgcagctctgcagcacaggcagcctaggcctgcgtcccaacctgcctctcaccagctctgtgaccttgggcaagggatttatctgtctgtcccttagttttctcacctgtaaaaggaggataagtatatatatatatttcccagtgttgtgaagattaaaggagtttatcgatgtaggtcttaggatgagtcctggcatttaccaagggttggatatatgttattatcactattaagtgttgagggtccaggcatgctgggcaacagggaccccatctctacaaaaaagtttaaaaaattagccaggcgtggtggtgcacctgtcgtcttagctacttgggaggctgaggtgggaggatcacttgagcccagaagcttgaagctgcagtgagctaggatcgtgccactgcactccaacctgggtgagagagcgagaccctgtctcaagaaaaagaaaaatgcagagaaacaggagtcttggctactcctttagaggcagactcagaccctcctgcctcacagctttatctttgtatttgccccttactttatcttgtgccttgagaaattgctggggagagaggtatgtccactgggcagctgtacaggatggaggatatagggcgtttccactcccagcagccaggttccctcaccccaagctcacccactgttggggagattatctacaataacaccagaaacacattggggtggattgggggtatccttatgggttcttttcagggaaccattgctggacaaggcacaggagccacctccatttctgagctctgcaagggacaagaactagagccatcaggggctgggctcactgtggccccaccccaagccgtcagcctccagggatctacaccctgccttggctgctacagctttttcactccactgccctaggggagttcagcaacctaatgatctctatctctgaacatctcttcatcccatgctccaagtccagcaacctgcaccctggaaccaggagtggaccctacccgagctgtctgtattaatccccatcccccaccaccaatcttaaaaagccctctgtccccctaccctaaaccccagttaggtacccatgctgggcaggtcagttaacaatttatgcacaggtactagttttattgtattaccgttccagggtagctttgaaaaaagtatctcaaaaaggcaacaccaccgcgcccagccaaattaaattttttatagagatgaggtcatgctgttatgttgcccaggttggcctcatgagatcttgccttagcctcccaaagtgctgggattacagatgtgagacactgcacccaaaccccaccacttttttttttcctttttctttttttgagacagtcttactccgttgcccaggctggagtgtagtggcatgatctcagctcactgcaacctccgcctcccgggttcaagcaattctcctgcctcagcctcccgagtagctgggattacagaggcctgccaccacacccgactaattttcgtatttttagtagagacggggtttctccatgttggccaggctgttcttgaactcctgacctcaagtgctccacctgcgttggcttcccaaagtgctgggatacaggagtgagccactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaggccgaggtgggaggatcccttgaagccaggagtttgagacaagcctgggcaacaaagcaagaccctatctctaaaaaaaaaaaaaaaaaaaaatctaggagatgctctttaccctgcctggcctcaaactattaatagcttcctttgagcaacattatttattatgaactttcaaacacaaaaaagtagagagagtagaataacaaatccccatgagcccatcacccaacttcagtaattatcaattcatggccatcttgttcacccctgcctgcttccctgcttcccctcattctgcagaggttcttttcttttgagacagagtgttgctctgttgcccaggctggagtgcagtggtgcaacttcggctcactgcaacctccgcctcccaggttcaagtgattctcctgcttcagcctctcaagtagctgggattacagatgcccgccaccacacctggctaattttcgtatttttgttagagatggggtttcaccatgttggccaggctggtctcgaactcctgacctcaagtgatccgcccgccttggcctcccaaaatgctgggattacaggtgtgaaccacggtgcctggccactgtacaggttatttatagaagttggagagtgaagggttgagaaagccaaggggcagatgcgggtctggaggattttgtgcctaaggccctctctttgctcccagacagcatgaagtaacaatgaggcatccacctcttggttttgtggcctctgtggatgacgtctctcaccttgaaccagttcagagttggagtagcgcaggatcctgtcttcagaggaggggccgaagcgggttcctctgttgtcaagctctttggaggtgcctggctgctactactgtcccagagaggtgatgatgaatgatgggtgtgtccagtggcagtttgccccactgaggcaggggcttccactaggccctgacagagcccttccagcaggcagaaatccctgtgctaggcaagattcaaactccgtagcatgtctcctgctcccatctcttaggaatggagtccttcaggccttgagtcccacattttccatgatgctccattaagcagctgatagcacccccacctccagggaaagtgagttcagagtccttggtctaatgcatctgtgttgaaattgaggccttcccctgtgttcacctttctgctctttttcttttagcccaaggctatgaaggcctcattcggtgctgggcatggtcactcctagcattcctcactctgttgctaacagcaacagcaataataataagggttacaacttactccataccttactgtctgccaggcattaagctaagtgctttacatatattaagtcatttaatcctcataatgaccctatgaaagagataccatctcaacccaattgacagctggtttgcaagattaggagggatgaaggacccaggggacaatgcgagggaaaactctgaccccggggccccaggctggatgttctttatgcctgtgaaccacagcttatcacatgtctggagttagggaccccacttaaagtgagattttggctggaggtggtggatcatacctataatcccagcactttgggagaccaaggcagaaggactgcttgaggccaggagttcaaaaccagtgtaggtaacagctagaccctatctctacaaaaaatttaaaaattagctgggtgtggtggtatgtgcctcaagttccagctactcaggaggctgaggtgggaggatcacttgagcacaggagtttgaagttacagtgagctatgatggcaccactgcacttcagcctaggcaacagagggagaccctgtctttaaagtacatagaggtttttcacaccaacacatctctgcccagtgtgccaacatctgccacctgctataatagtactataacactcaatatgtaattaatgtagtctcagggatgttatgacaatatgattacaactatcacgtgtgtgcccagccaggctcaatgccccaggctgggcgaggtggggcaggggacacagcctaaaatgccaggcctcaggaagccatttggtttagcagacattgtttattaaaggagttacctatgccagatcgaaggcctaagatgattaagacactatgagtgccttcaagtggttggggacgttcatgattgtggtacagacaaataggctttcacatcattcttttatgtaatcatacaacagatatttgcacctacatgtgcagagcactgtgataggcctcagtgacacagaataatacggcaaagaccccacccgatgagccccctcccaccacccaccagtacagtagggggtggtttaatggagtgttcctggaatatgaagtgggggcaggcattaggggtggcaaagggacaagtgtttatctgatcagttatgtactgtttataataagtaaatcagcagagggggaataatacttagaacctatagagagtaaatctgacaagatgaaatgctgatgaaaatatggaggaaatgaaactctcatgggttttgcagggaatctaagtcagtgctgtgttgtgaatgtaggtgtaccctttgaattcatatgttgaatcctaacccccaaagcaatggcattaagaggtggggcctttggggctgggtatggtggctcatgactgtaatcccagcactttgggatgctggcagggggcagatcacttgaagccaggagtctgagatcagcctggccaacatggtgaaaccccatctgtactaaaaatacaaaaattagccaggtgtgatggcgtacatctgtaatttcagccactcgggaggctgagacaggagaatagcttgaacccagtaggtggagatttcagtgagccgagatcgtgccactgcactccagcctgggtgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaaga

SEQ ID NO: 437627 - DNA, 9560 bp, Homo sapiens
gcgggaagggtcctgggccccgggcggcggtcgccaggtctcagggccgggggtacccgagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtatacctggcccctctccgaagccccttgtccctttcttggggattgtggaggctgggtcagaggggagttaagggactgcaggcctggcagcaggacatgccttggctgaaccaagtcctgagagcagcatctctgtccccacggtgccttgtgtgggtccccgtccttggctttctgggtcctgggctgcccccagtgctccagaccttccccactggcaatccaggttatcatccatgtcctccagaggagcttcctcctccaggcctcagccctgttggcccaggtggagcaggagggaccactggaacatgtggtgcttgggaatgcctctcctgttgcattggtccctgaaggcctcagggcaggtatgtggtgtgtgggcgactccacaagacctgcctcccatcctggcagcccagcctgagaccgttgcattgaggcaggcaggagcggcagggtggctgctctccaggagcccaactgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtagagctgagggcatgagaggcagagtgcacagtggtcaagggtgcagctctgcagcacaggcagcctaggcctgcgtcccaacctgcctctcaccagctctgtgaccttgggcaagggatttatctgtctgtcccttagttttctcacctgtaaaaggaggataagtatatatatatatttcccagtgttgtgaagattaaaggagtttatcgatgtaggtcttaggatgagtcctggcatttaccaagggttggatatatgttattatcactattaagtgttgagggtccaggcatgctgggcaacagggaccccatctctacaaaaaagtttaaaaaattagccaggcgtggtggtgcacctgtcgtcttagctacttgggaggctgaggtgggaggatcacttgagcccagaagcttgaagctgcagtgagctaggatcgtgccactgcactccaacctgggtgagagagcgagaccctgtctcaagaaaaagaaaaatgcagagaaacaggagtcttggctactcctttagaggcagactcagaccctcctgcctcacagctttatctttgtatttgccccttactttatcttgtgccttgagaaattgctggggagagaggtatgtccactgggcagctgtacaggatggaggatatagggcgtttccactcccagcagccaggttccctcaccccaagctcacccactgttggggagattatctacaataacaccagaaacacattggggtggattgggggtatccttatgggttcttttcagggaaccattgctggacaaggcacaggagccacctccatttctgagctctgcaagggacaagaactagagccatcaggggctgggctcactgtggccccaccccaagccgtcagcctccagggatctacaccctgccttggctgctacagctttttcactccactgccctaggggagttcagcaacctaatgatctctatctctgaacatctcttcatcccatgctccaagtccagcaacctgcaccctggaaccaggagtggaccctacccgagctgtctgtattaatccccatcccccaccaccaatcttaaaaagccctctgtccccctaccctaaaccccagttaggtacccatgctgggcaggtcagttaacaatttatgcacaggtactagttttattgtattaccgttccagggtagctttgaaaaaagtatctcaaaaaggcaacaccaccgcgcccagccaaattaaattttttatagagatgaggtcatgctgttatgttgcccaggttggcctcatgagatcttgccttagcctcccaaagtgctgggattacagatgtgagacactgcacccaaaccccaccacttttttttttcctttttctttttttgagacagtcttactccgttgcccaggctggagtgtagtggcatgatctcagctcactgcaacctccgcctcccgggttcaagcaattctcctgcctcagcctcccgagtagctgggattacagaggcctgccaccacacccgactaattttcgtatttttagtagagacggggtttctccatgttggccaggctgttcttgaactcctgacctcaagtgctccacctgcgttggcttcccaaagtgctgggatacaggagtgagccactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaggccgaggtgggaggatcccttgaagccaggagtttgagacaagcctgggcaacaaagcaagaccctatctctaaaaaaaaaaaaaaaaaaaaatctaggagatgctctttaccctgcctggcctcaaactattaatagcttcctttgagcaacattatttattatgaactttcaaacacaaaaaagtagagagagtagaataacaaatccccatgagcccatcacccaacttcagtaattatcaattcatggccatcttgttcacccctgcctgcttccctgcttcccctcattctgcagaggttcttttcttttgagacagagtgttgctctgttgcccaggctggagtgcagtggtgcaacttcggctcactgcaacctccgcctcccaggttcaagtgattctcctgcttcagcctctcaagtagctgggattacagatgcccgccaccacacctggctaattttcgtatttttgttagagatggggtttcaccatgttggccaggctggtctcgaactcctgacctcaagtgatccgcccgccttggcctcccaaaatgctgggattacaggtgtgaaccacggtgcctggccactgtacaggttatttatagaagttggagagtgaagggttgagaaagccaaggggcagatgcgggtctggaggattttgtgcctaaggccctctctttgctcccagacagcatgaagtaacaatgaggcatccacctcttggttttgtggcctctgtggatgacgtctctcaccttgaaccagttcagagttggagtagcgcaggatcctgtcttcagaggaggggccgaagcgggttcctctgttgtcaagctctttggaggtgcctggctgctactactgtcccagagaggtgatgatgaatgatgggtgtgtccagtggcagtttgccccactgaggcaggggcttccactaggccctgacagagcccttccagcaggcagaaatccctgtgctaggcaagattcaaactccgtagcatgtctcctgctcccatctcttaggaatggagtccttcaggccttgagtcccacattttccatgatgctccattaagcagctgatagcacccccacctccagggaaagtgagttcagagtccttggtctaatgcatctgtgttgaaattgaggccttcccctgtgttcacctttctgctctttttcttttagcccaaggctatgaaggcctcattcggtgctgggcatggtcactcctagcattcctcactctgttgctaacagcaacagcaataataataagggttacaacttactccataccttactgtctgccaggcattaagctaagtgctttacatatattaagtcatttaatcctcataatgaccctatgaaagagataccatctcaacccaattgacagctggtttgcaagattaggagggatgaaggacccaggggacaatgcgagggaaaactctgaccccggggccccaggctggatgttctttatgcctgtgaaccacagcttatcacatgtctggagttagggaccccacttaaagtgagattttggctggaggtggtggatcatacctataatcccagcactttgggagaccaaggcagaaggactgcttgaggccaggagttcaaaaccagtgtaggtaacagctagaccctatctctacaaaaaatttaaaaattagctgggtgtggtggtatgtgcctcaagttccagctactcaggaggctgaggtgggaggatcacttgagcacaggagtttgaagttacagtgagctatgatggcaccactgcacttcagcctaggcaacagagggagaccctgtctttaaagtacatagaggtttttcacaccaacacatctctgcccagtgtgccaacatctgccacctgctataatagtactataacactcaatatgtaattaatgtagtctcagggatgttatgacaatatgattacaactatcacgtgtgtgcccagccaggctcaatgccccaggctgggcgaggtggggcaggggacacagcctaaaatgccaggcctcaggaagccatttggtttagcagacattgtttattaaaggagttacctatgccagatcgaaggcctaagatgattaagacactatgagtgccttcaagtggttggggacgttcatgattgtggtacagacaaataggctttcacatcattcttttatgtaatcatacaacagatatttgcacctacatgtgcagagcactgtgataggcctcagtgacacagaataatacggcaaagaccccacccgatgagccccctcccaccacccaccagtacagtagggggtggtttaatggagtgttctgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggttatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctgcaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagatagaataacaaatccccatgactccatctacccatctggaccactat

SEQ ID NO: 437628 - DNA, 10978 bp, Homo sapiens
gcggccgccggggtcggcagcctggggctccgctgatctagggcaacgagcgggggacgcttcgagcccgcagcgagagtgaccagcatggtccctgccggcagctcggggccggagggttttgactgcaaggccagcccacgccgagggtccaagcatcgggatatgccgccagcacctggctgctgcagcaccgcgctggacatgagcgctccgcccaacccgacggcgtcagctggcgcgcgcgcccgcgaccgacgtgcgcaggcgcccacgggccgcgcagccgccattgctctcctgccacggaggggagcgcttggtggcagtccgcgggcccggacggaaggctgaggcgacgcctcgacgacagcggaccggagctgcaggggcaacacattcagggcggggtgccccatttaggcctggctgaccggagtaagaaactacaacccccgaagtgccttgcgcctcaaggttacggaggcagtgacgtaagctgtcttgaccgctaccatttctctagtagaggcgggacgcggcggcgcggagtgatgacgcgctctgctggcggctggagggttgcggagcacccaccctggagccatggtccacgccttcctcattcacaccttgagggccccgaatactgaggacacgggcctttgccgagtgctgtactcctgcgtcttcggtgctgagaagtcacctgatgacccacggccgcatggtgccgagagggacaggcttctccggaaggaacagattttagctgtggccagcggcaggtgacgagccacacagtgtcctgaggcctgatgaaagggctatgccaaccacagtcccagaggaggagctggctgtagcagcgactgacccaggagctgaagtgagccaagccccctcctcctgagacccctgagagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtatacctggcccctctccgaagccccttgtccctttcttggggattgtggaggctgggtcagaggggagttaagggactgcaggcctggcagcaggacatgccttggctgaaccaagtcctgagagcagcatctctgtccccacggtgccttgtgtgggtccccgtccttggctttctgggtcctgggctgcccccagtgctccagaccttccccactggcaatccaggttatcatccatgtcctccagaggagcttcctcctccaggcctcagccctgttggcccaggtggagcaggagggaccactggaacatgtggtgcttgggaatgcctctcctgttgcattggtccctgaaggcctcagggcaggtatgtggtgtgtgggcgactccacaagacctgcctcccatcctggcagcccagcctgagaccgttgcattgaggcaggcaggagcggcagggtggctgctctccaggagcccaactgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtagagctgagggcatgagaggcagagtgcacagtggtcaagggtgcagctctgcagcacaggcagcctaggcctgcgtcccaacctgcctctcaccagctctgtgaccttgggcaagggatttatctgtctgtcccttagttttctcacctgtaaaaggaggataagtatatatatatatttcccagtgttgtgaagattaaaggagtttatcgatgtaggtcttaggatgagtcctggcatttaccaagggttggatatatgttattatcactattaagtgttgagggtccaggcatgctgggcaacagggaccccatctctacaaaaaagtttaaaaaattagccaggcgtggtggtgcacctgtcgtcttagctacttgggaggctgaggtgggaggatcacttgagcccagaagcttgaagctgcagtgagctaggatcgtgccactgcactccaacctgggtgagagagcgagaccctgtctcaagaaaaagaaaaatgcagagaaacaggagtcttggctactcctttagaggcagactcagaccctcctgcctcacagctttatctttgtatttgccccttactttatcttgtgccttgagaaattgctggggagagaggtatgtccactgggcagctgtacaggatggaggatatagggcgtttccactcccagcagccaggttccctcaccccaagctcacccactgttggggagattatctacaataacaccagaaacacattggggtggattgggggtatccttatgggttcttttcagggaaccattgctggacaaggcacaggagccacctccatttctgagctctgcaagggacaagaactagagccatcaggggctgggctcactgtggccccaccccaagccgtcagcctccagggatctacaccctgccttggctgctacagctttttcactccactgccctaggggagttcagcaacctaatgatctctatctctgaacatctcttcatcccatgctccaagtccagcaacctgcaccctggaaccaggagtggaccctacccgagctgtctgtattaatccccatcccccaccaccaatcttaaaaagccctctgtccccctaccctaaaccccagttaggtacccatgctgggcaggtcagttaacaatttatgcacaggtactagttttattgtattaccgttccagggtagctttgaaaaaagtatctcaaaaaggcaacaccaccgcgcccagccaaattaaattttttatagagatgaggtcatgctgttatgttgcccaggttggcctcatgagatcttgccttagcctcccaaagtgctgggattacagatgtgagacactgcacccaaaccccaccacttttttttttcctttttctttttttgagacagtcttactccgttgcccaggctggagtgtagtggcatgatctcagctcactgcaacctccgcctcccgggttcaagcaattctcctgcctcagcctcccgagtagctgggattacagaggcctgccaccacacccgactaattttcgtatttttagtagagacggggtttctccatgttggccaggctgttcttgaactcctgacctcaagtgctccacctgcgttggcttcccaaagtgctgggatacaggagtgagccactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaggccgaggtgggaggatcccttgaagccaggagtttgagacaagcctgggcaacaaagcaagaccctatctctaaaaaaaaaaaaaaaaaaaaatctaggagatgctctttaccctgcctggcctcaaactattaatagcttcctttgagcaacattatttattatgaactttcaaacacaaaaaagtagagagagtagaataacaaatccccatgagcccatcacccaacttcagtaattatcaattcatggccatcttgttcacccctgcctgcttccctgcttcccctcattctgcagaggttcttttcttttgagacagagtgttgctctgttgcccaggctggagtgcagtggtgcaacttcggctcactgcaacctccgcctcccaggttcaagtgattctcctgcttcagcctctcaagtagctgggattacagatgcccgccaccacacctggctaattttcgtatttttgttagagatggggtttcaccatgttggccaggctggtctcgaactcctgacctcaagtgatccgcccgccttggcctcccaaaatgctgggattacaggtgtgaaccacggtgcctggccactgtacaggttatttatagaagttggagagtgaagggttgagaaagccaaggggcagatgcgggtctggaggattttgtgcctaaggccctctctttgctcccagacagcatgaagtaacaatgaggcatccacctcttggttttgtggcctctgtggatgacgtctctcaccttgaaccagttcagagttggagtagcgcaggatcctgtcttcagaggaggggccgaagcgggttcctctgttgtcaagctctttggaggtgcctggctgctactactgtcccagagaggtgatgatgaatgatgggtgtgtccagtggcagtttgccccactgaggcaggggcttccactaggccctgacagagcccttccagcaggcagaaatccctgtgctaggcaagattcaaactccgtagcatgtctcctgctcccatctcttaggaatggagtccttcaggccttgagtcccacattttccatgatgctccattaagcagctgatagcacccccacctccagggaaagtgagttcagagtccttggtctaatgcatctgtgttgaaattgaggccttcccctgtgttcacctttctgctctttttcttttagcccaaggctatgaaggcctcattcggtgctgggcatggtcactcctagcattcctcactctgttgctaacagcaacagcaataataataagggttacaacttactccataccttactgtctgccaggcattaagctaagtgctttacatatattaagtcatttaatcctcataatgaccctatgaaagagataccatctcaacccaattgacagctggtttgcaagattaggagggatgaaggacccaggggacaatgcgagggaaaactctgaccccggggccccaggctggatgttctttatgcctgtgaaccacagcttatcacatgtctggagttagggaccccacttaaagtgagattttggctggaggtggtggatcatacctataatcccagcactttgggagaccaaggcagaaggactgcttgaggccaggagttcaaaaccagtgtaggtaacagctagaccctatctctacaaaaaatttaaaaattagctgggtgtggtggtatgtgcctcaagttccagctactcaggaggctgaggtgggaggatcacttgagcacaggagtttgaagttacagtgagctatgatggcaccactgcacttcagcctaggcaacagagggagaccctgtctttaaagtacatagaggtttttcacaccaacacatctctgcccagtgtgccaacatctgccacctgctataatagtactataacactcaatatgtaattaatgtagtctcagggatgttatgacaatatgattacaactatcacgtgtgtgcccagccaggctcaatgccccaggctgggcgaggtggggcaggggacacagcctaaaatgccaggcctcaggaagccatttggtttagcagacattgtttattaaaggagttacctatgccagatcgaaggcctaagatgattaagacactatgagtgccttcaagtggttggggacgttcatgattgtggtacagacaaataggctttcacatcattcttttatgtaatcatacaacagatatttgcacctacatgtgcagagcactgtgataggcctcagtgacacagaataatacggcaaagaccccacccgatgagccccctcccaccacccaccagtacagtagggggtggtttaatggagtgttcctggaatatgaagtgggggcaggcattaggggtggcaaagggacaagtgtttatctgatcagttatgtactgtttataataagtaaatcagcagagggggaataatacttagaacctatagagagtaaatctgacaagatgaaatgctgatgaaaatatggaggaaatgaaactctcatgggttttgcagggaatctaagtcagtgctgtgttgtgaatgtaggtgtaccctttgaattcatatgttgaatcctaacccccaaagcaatggcattaagaggtggggcctttggggctgggtatggtggctcatgactgtaatcccagcactttgggatgctggcagggggcagatcacttgaagccaggagtctgagatcagcctggccaacatggtgaaaccccatctgtactaaaaatacaaaaattagccaggtgtgatggcgtacatctgtaatttcagccactcgggaggctgagacaggagaatagcttgaacccagtaggtggagatttcagtgagccgagatcgtgccactgcactccagcctgggtgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggttatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctgcaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagatagaataacaaatccccatgactccatctacccatctggaccactat

SEQ ID NO: 437629 - DNA, 10882 bp, Homo sapiens
gcggccgccggggtcggcagcctggggctccgctgatctagggcaacgagcgggggacgcttcgagcccgcagcgagagtgaccagcatggtccctgccggcagctcggggccggagggttttgactgcaaggccagcccacgccgagggtccaagcatcgggatatgccgccagcacctggctgctgcagcaccgcgctggacatgagcgctccgcccaacccgacggcgtcagctggcgcgcgcgcccgcgaccgacgtgcgcaggcgcccacgggccgcgcagccgccattgctctcctgccacggaggggagcgcttggtggcagtccgcgggcccggacggaaggctgaggcgacgcctcgacgacagcggaccggagctgcaggggcaacacattcagggcggggtgccccatttaggcctggctgaccggagtaagaaactacaacccccgaagtgccttgcgcctcaaggttacggaggcagtgaccacccaccctggagccatggtccacgccttcctcattcacaccttgagggccccgaatactgaggacacgggcctttgccgagtgctgtactcctgcgtcttcggtgctgagaagtcacctgatgacccacggccgcatggtgccgagagggacaggcttctccggaaggaacagattttagctgtggccagcggcaggtgacgagccacacagtgtcctgaggcctgatgaaagggctatgccaaccacagtcccagaggaggagctggctgtagcagcgactgacccaggagctgaagtgagccaagccccctcctcctgagacccctgagagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtatacctggcccctctccgaagccccttgtccctttcttggggattgtggaggctgggtcagaggggagttaagggactgcaggcctggcagcaggacatgccttggctgaaccaagtcctgagagcagcatctctgtccccacggtgccttgtgtgggtccccgtccttggctttctgggtcctgggctgcccccagtgctccagaccttccccactggcaatccaggttatcatccatgtcctccagaggagcttcctcctccaggcctcagccctgttggcccaggtggagcaggagggaccactggaacatgtggtgcttgggaatgcctctcctgttgcattggtccctgaaggcctcagggcaggtatgtggtgtgtgggcgactccacaagacctgcctcccatcctggcagcccagcctgagaccgttgcattgaggcaggcaggagcggcagggtggctgctctccaggagcccaactgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtagagctgagggcatgagaggcagagtgcacagtggtcaagggtgcagctctgcagcacaggcagcctaggcctgcgtcccaacctgcctctcaccagctctgtgaccttgggcaagggatttatctgtctgtcccttagttttctcacctgtaaaaggaggataagtatatatatatatttcccagtgttgtgaagattaaaggagtttatcgatgtaggtcttaggatgagtcctggcatttaccaagggttggatatatgttattatcactattaagtgttgagggtccaggcatgctgggcaacagggaccccatctctacaaaaaagtttaaaaaattagccaggcgtggtggtgcacctgtcgtcttagctacttgggaggctgaggtgggaggatcacttgagcccagaagcttgaagctgcagtgagctaggatcgtgccactgcactccaacctgggtgagagagcgagaccctgtctcaagaaaaagaaaaatgcagagaaacaggagtcttggctactcctttagaggcagactcagaccctcctgcctcacagctttatctttgtatttgccccttactttatcttgtgccttgagaaattgctggggagagaggtatgtccactgggcagctgtacaggatggaggatatagggcgtttccactcccagcagccaggttccctcaccccaagctcacccactgttggggagattatctacaataacaccagaaacacattggggtggattgggggtatccttatgggttcttttcagggaaccattgctggacaaggcacaggagccacctccatttctgagctctgcaagggacaagaactagagccatcaggggctgggctcactgtggccccaccccaagccgtcagcctccagggatctacaccctgccttggctgctacagctttttcactccactgccctaggggagttcagcaacctaatgatctctatctctgaacatctcttcatcccatgctccaagtccagcaacctgcaccctggaaccaggagtggaccctacccgagctgtctgtattaatccccatcccccaccaccaatcttaaaaagccctctgtccccctaccctaaaccccagttaggtacccatgctgggcaggtcagttaacaatttatgcacaggtactagttttattgtattaccgttccagggtagctttgaaaaaagtatctcaaaaaggcaacaccaccgcgcccagccaaattaaattttttatagagatgaggtcatgctgttatgttgcccaggttggcctcatgagatcttgccttagcctcccaaagtgctgggattacagatgtgagacactgcacccaaaccccaccacttttttttttcctttttctttttttgagacagtcttactccgttgcccaggctggagtgtagtggcatgatctcagctcactgcaacctccgcctcccgggttcaagcaattctcctgcctcagcctcccgagtagctgggattacagaggcctgccaccacacccgactaattttcgtatttttagtagagacggggtttctccatgttggccaggctgttcttgaactcctgacctcaagtgctccacctgcgttggcttcccaaagtgctgggatacaggagtgagccactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaggccgaggtgggaggatcccttgaagccaggagtttgagacaagcctgggcaacaaagcaagaccctatctctaaaaaaaaaaaaaaaaaaaaatctaggagatgctctttaccctgcctggcctcaaactattaatagcttcctttgagcaacattatttattatgaactttcaaacacaaaaaagtagagagagtagaataacaaatccccatgagcccatcacccaacttcagtaattatcaattcatggccatcttgttcacccctgcctgcttccctgcttcccctcattctgcagaggttcttttcttttgagacagagtgttgctctgttgcccaggctggagtgcagtggtgcaacttcggctcactgcaacctccgcctcccaggttcaagtgattctcctgcttcagcctctcaagtagctgggattacagatgcccgccaccacacctggctaattttcgtatttttgttagagatggggtttcaccatgttggccaggctggtctcgaactcctgacctcaagtgatccgcccgccttggcctcccaaaatgctgggattacaggtgtgaaccacggtgcctggccactgtacaggttatttatagaagttggagagtgaagggttgagaaagccaaggggcagatgcgggtctggaggattttgtgcctaaggccctctctttgctcccagacagcatgaagtaacaatgaggcatccacctcttggttttgtggcctctgtggatgacgtctctcaccttgaaccagttcagagttggagtagcgcaggatcctgtcttcagaggaggggccgaagcgggttcctctgttgtcaagctctttggaggtgcctggctgctactactgtcccagagaggtgatgatgaatgatgggtgtgtccagtggcagtttgccccactgaggcaggggcttccactaggccctgacagagcccttccagcaggcagaaatccctgtgctaggcaagattcaaactccgtagcatgtctcctgctcccatctcttaggaatggagtccttcaggccttgagtcccacattttccatgatgctccattaagcagctgatagcacccccacctccagggaaagtgagttcagagtccttggtctaatgcatctgtgttgaaattgaggccttcccctgtgttcacctttctgctctttttcttttagcccaaggctatgaaggcctcattcggtgctgggcatggtcactcctagcattcctcactctgttgctaacagcaacagcaataataataagggttacaacttactccataccttactgtctgccaggcattaagctaagtgctttacatatattaagtcatttaatcctcataatgaccctatgaaagagataccatctcaacccaattgacagctggtttgcaagattaggagggatgaaggacccaggggacaatgcgagggaaaactctgaccccggggccccaggctggatgttctttatgcctgtgaaccacagcttatcacatgtctggagttagggaccccacttaaagtgagattttggctggaggtggtggatcatacctataatcccagcactttgggagaccaaggcagaaggactgcttgaggccaggagttcaaaaccagtgtaggtaacagctagaccctatctctacaaaaaatttaaaaattagctgggtgtggtggtatgtgcctcaagttccagctactcaggaggctgaggtgggaggatcacttgagcacaggagtttgaagttacagtgagctatgatggcaccactgcacttcagcctaggcaacagagggagaccctgtctttaaagtacatagaggtttttcacaccaacacatctctgcccagtgtgccaacatctgccacctgctataatagtactataacactcaatatgtaattaatgtagtctcagggatgttatgacaatatgattacaactatcacgtgtgtgcccagccaggctcaatgccccaggctgggcgaggtggggcaggggacacagcctaaaatgccaggcctcaggaagccatttggtttagcagacattgtttattaaaggagttacctatgccagatcgaaggcctaagatgattaagacactatgagtgccttcaagtggttggggacgttcatgattgtggtacagacaaataggctttcacatcattcttttatgtaatcatacaacagatatttgcacctacatgtgcagagcactgtgataggcctcagtgacacagaataatacggcaaagaccccacccgatgagccccctcccaccacccaccagtacagtagggggtggtttaatggagtgttcctggaatatgaagtgggggcaggcattaggggtggcaaagggacaagtgtttatctgatcagttatgtactgtttataataagtaaatcagcagagggggaataatacttagaacctatagagagtaaatctgacaagatgaaatgctgatgaaaatatggaggaaatgaaactctcatgggttttgcagggaatctaagtcagtgctgtgttgtgaatgtaggtgtaccctttgaattcatatgttgaatcctaacccccaaagcaatggcattaagaggtggggcctttggggctgggtatggtggctcatgactgtaatcccagcactttgggatgctggcagggggcagatcacttgaagccaggagtctgagatcagcctggccaacatggtgaaaccccatctgtactaaaaatacaaaaattagccaggtgtgatggcgtacatctgtaatttcagccactcgggaggctgagacaggagaatagcttgaacccagtaggtggagatttcagtgagccgagatcgtgccactgcactccagcctgggtgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggttatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctgcaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagatagaataacaaatccccatgactccatctacccatctggaccactat

SEQ ID NO: 437630 - DNA, 10478 bp, Homo sapiens
gcggccgccggggtcggcagcctggggctccgctgatctagggcaacgagcgggggacgcttcgagcccgcagcgagagtgaccagcatggtccctgccggcagctcggggccggagggttttgactgcaaggccagcccacgccgagggtccaagcatcgggatatgccgccagcacctggctgctgcagcaccgcgctggacatgagcgctccgcccaacccgacggcgtcagctggcgcgcgcgcccgcgaccgacgtgcgcaggcgcccacgggccgcgcagccgccattgctctcctgccacggaggggagcgcttggtggcagtccgcgggcccggacggaaggctgaggcgacgcctcgacgacagcggaccggagctgcaggggcaacacattcagggcggggtgccccatttaggcctggctgaccggacacccaccctggagccatggtccacgccttcctcattcacaccttgagggccccgaatactgaggacacgggcctttgccgagtgctgtactcctgcgtcttcggtgctgagaagtcacctgatgacccacggccgcatggtgccgagagggacaggcttctccggaaggaacagattttagctgtggccagcggcaggtgacgagccacacagtgtcctgaggcctgatgaaagggctatgccaaccacagtcccagaggaggagctggctgtagcagcgactgacccaggagctgaagtgagccaagccccctcctcctgagacccctgagagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtatacctggcccctctccgaagccccttgtccctttcttggggattgtggaggctgggtcagaggggagttaagggactgcaggcctggcagcaggacatgccttggctgaaccaagtcctgagagcagcatctctgtccccacggtgccttgtgtgggtccccgtccttggctttctgggtcctgggctgcccccagtgctccagaccttccccactggcaatccaggttatcatccatgtcctccagaggagcttcctcctccaggcctcagccctgttggcccaggtggagcaggagggaccactggaacatgtggtgcttgggaatgcctctcctgttgcattggtccctgaaggcctcagggcaggtatgtggtgtgtgggcgactccacaagacctgcctcccatcctggcagcccagcctgagaccgttgcattgaggcaggcaggagcggcagggtggctgctctccaggagcccaactgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtagagctgagggcatgagaggcagagtgcacagtggtcaagggtgcagctctgcagcacaggcagcctaggcctgcgtcccaacctgcctctcaccagctctgtgaccttgggcaagggatttatctgtctgtcccttagttttctcacctgtaaaaggaggataagtatatatatatatttcccagtgttgtgaagattaaaggagtttatcgatgtaggtcttaggatgagtcctggcatttaccaagggttggatatatgttattatcactattaagtgttgagggtccaggcatgctgggcaacagggaccccatctctacaaaaaagtttaaaaaattagccaggcgtggtggtgcacctgtcgtcttagctacttgggaggctgaggtgggaggatcacttgagcccagaagcttgaagctgcagtgagctaggatcgtgccactgcactccaacctgggtgagagagcgagaccctgtctcaagaaaaagaaaaatgcagagaaacaggagtcttggctactcctttagaggcagactcagaccctcctgcctcacagctttatctttgtatttgccccttactttatcttgtgccttgagaaattgctggggagagaggtatgtccactgggcagctgtacaggatggaggatatagggcgtttccactcccagcagccaggttccctcaccccaagctcacccactgttggggagattatctacaataacaccagaaacacattggggtggattgggggtatccttatgggttcttttcagggaaccattgctggacaaggcacaggagccacctccatttctgagctctgcaagggacaagaactagagccatcaggggctgggctcactgtggccccaccccaagccgtcagcctccagggatctacaccctgccttggctgctacagctttttcactccactgccctaggggagttcagcaacctaatgatctctatctctgaacatctcttcatcccatgctccaagtccagcaacctgcaccctggaaccaggagtggaccctacccgagctgtctgtattaatccccatcccccaccaccaatcttaaaaagccctctgtccccctaccctaaaccccagttaggtacccatgctgggcaggtcagttaacaatttatgcacaggtactagttttattgtattaccgttccagggtagctttgaaaaaagtatctcaaaaaggcaacaccaccgcgcccagccaaattaaattttttatagagatgaggtcatgctgttatgttgcccaggttggcctcatgagatcttgccttagcctcccaaagtgctgggattacagatgtgagacactgcacccaaaccccaccacttttttttttcctttttctttttttgagacagtcttactccgttgcccaggctggagtgtagtggcatgatctcagctcactgcaacctccgcctcccgggttcaagcaattctcctgcctcagcctcccgagtagctgggattacagaggcctgccaccacacccgactaattttcgtatttttagtagagacggggtttctccatgttggccaggctgttcttgaactcctgacctcaagtgctccacctgcgttggcttcccaaagtgctgggatacaggagtgagccactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaggccgaggtgggaggatcccttgaagccaggagtttgagacaagcctgggcaacaaagcaagaccctatctctaaaaaaaaaaaaaaaaaaaaatctaggagatgctctttaccctgcctggcctcaaactattaatagcttcctttgagcaacattatttattatgaactttcaaacacaaaaaagtagagagagtagaataacaaatccccatgagcccatcacccaacttcagtaattatcaattcatggccatcttgttcacccctgcctgcttccctgcttcccctcattctgcagaggttcttttcttttgagacagagtgttgctctgttgcccaggctggagtgcagtggtgcaacttcggctcactgcaacctccgcctcccaggttcaagtgattctcctgcttcagcctctcaagtagctgggattacagatgcccgccaccacacctggctaattttcgtatttttgttagagatggggtttcaccatgttggccaggctggtctcgaactcctgacctcaagtgatccgcccgccttggcctcccaaaatgctgggattacaggtgtgaaccacggtgcctggccactgtacaggttatttatagaagttggagagtgaagggttgagaaagccaaggggcagatgcgggtctggaggattttgtgcctaaggccctctctttgctcccagacagcatgaagtaacaatgaggcatccacctcttggttttgtggcctctgtggatgacgtctctcaccttgaaccagttcagagttggagtagcgcaggatcctgtcttcagaggaggggccgaagcgggttcctctgttgtcaagctctttggaggtgcctggctgctactactgtcccagagaggtgatgatgaatgatgggtgtgtccagtggcagtttgccccactgaggcaggggcttccactaggccctgacagagcccttccagcaggcagaaatccctgtgctaggcaagattcaaactccgtagcatgtctcctgctcccatctcttaggaatggagtccttcaggccttgagtcccacattttccatgatgctccattaagcagctgatagcacccccacctccagggaaagtgagttcagagtccttggtctaatgcatctgtgttgaaattgaggccttcccctgtgttcacctttctgctctttttcttttagcccaaggctatgaaggcctcattcggtgctgggcatggtcactcctagcattcctcactctgttgctaacagcaacagcaataataataagggttacaacttactccataccttactgtctgccaggcattaagctaagtgctttacatatattaagtcatttaatcctcataatgaccctatgaaagagataccatctcaacccaattgacagctggtttgcaagattaggagggatgaaggacccaggggacaatgcgagggaaaactctgaccccggggccccaggctggatgttctttatgcctgtgaaccacagcttatcacatgtctggagttagggaccccacttaaagtgagattttggctggaggtggtggatcatacctataatcccagcactttgggagaccaaggcagaaggactgcttgaggccaggagttcaaaaccagtgtaggtaacagctagaccctatctctacaaaaaatttaaaaattagctgggtgtggtggtatgtgcctcaagttccagctactcaggaggctgaggtgggaggatcacttgagcacaggagtttgaagttacagtgagctatgatggcaccactgcacttcagcctaggcaacagagggagaccctgtctttaaagtacatagaggtttttcacaccaacacatctctgcccagtgtgccaacatctgccacctgctataatagtactataacactcaatatgtaattaatgtagtctcagggatgttatgacaatatgattacaactatcacgtgtgtgcccagccaggctcaatgccccaggctgggcgaggtggggcaggggacacagcctaaaatgccaggcctcaggaagccatttggtttagcagacattgtttattaaaggagttacctatgccagatcgaaggcctaagatgattaagacactatgagtgccttcaagtggttggggacgttcatgattgtggtacagacaaataggctttcacatcattcttttatgtaatcatacaacagatatttgcacctacatgtgcagagcactgtgataggcctcagtgacacagaataatacggcaaagaccccacccgatgagccccctcccaccacccaccagtacagtagggggtggtttaatggagtgttcctggaatatgaagtgggggcaggcattaggggtggcaaagggacaagtgtttatctgatcagttatgtactgtttataataagtaaatcagcagagggggaataatacttagaacctatagagagtaaatctgacaagatgaaatgctgatgaaaatatggaggaaatgaaactctcatgggttttgcagggaatctaagtcagtgctgtgttgtgaatgtaggtgtaccctttgaattcatatgttgaatcctaacccccaaagcaatggcattaagaggtggggcctttggggctgggtatggtggctcatgactgtaatcccagcactttgggatgctggcagggggcagatcacttgaagccaggagtctgagatcagcctggccaacatggtgaaaccccatctgtactaaaaatacaaaaattagccaggtgtgatggcgtacatctgtaatttcagccactcgggaggctgagacaggagaatagcttgaacccagtaggtggagatttcagtgagccgagatcgtgccactgcactccagcctgggtgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggttatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctgcaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagatagaataacaaatccccatgactccatctacccatctggaccactat

SEQ ID NO: 437631 - DNA, 9942 bp, Homo sapiens
gatcccccctgagcttgctcaggatctcctggagatatgctctggactacaggacattgccactaatttcccagattaatttaggggtatttgttgtagagatggggtttcactgtgttagccagggtggtctcgatctgacctcgtgatctgcctgccttggcctcccaaagtgctgagattacaggcatgagccactgtgcccagccctgattccttcttgatatcactacatctttgtcctctagggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtatacctggcccctctccgaagccccttgtccctttcttggggattgtggaggctgggtcagaggggagttaagggactgcaggcctggcagcaggacatgccttggctgaaccaagtcctgagagcagcatctctgtccccacggtgccttgtgtgggtccccgtccttggctttctgggtcctgggctgcccccagtgctccagaccttccccactggcaatccaggttatcatccatgtcctccagaggagcttcctcctccaggcctcagccctgttggcccaggtggagcaggagggaccactggaacatgtggtgcttgggaatgcctctcctgttgcattggtccctgaaggcctcagggcaggtatgtggtgtgtgggcgactccacaagacctgcctcccatcctggcagcccagcctgagaccgttgcattgaggcaggcaggagcggcagggtggctgctctccaggagcccaactgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtagagctgagggcatgagaggcagagtgcacagtggtcaagggtgcagctctgcagcacaggcagcctaggcctgcgtcccaacctgcctctcaccagctctgtgaccttgggcaagggatttatctgtctgtcccttagttttctcacctgtaaaaggaggataagtatatatatatatttcccagtgttgtgaagattaaaggagtttatcgatgtaggtcttaggatgagtcctggcatttaccaagggttggatatatgttattatcactattaagtgttgagggtccaggcatgctgggcaacagggaccccatctctacaaaaaagtttaaaaaattagccaggcgtggtggtgcacctgtcgtcttagctacttgggaggctgaggtgggaggatcacttgagcccagaagcttgaagctgcagtgagctaggatcgtgccactgcactccaacctgggtgagagagcgagaccctgtctcaagaaaaagaaaaatgcagagaaacaggagtcttggctactcctttagaggcagactcagaccctcctgcctcacagctttatctttgtatttgccccttactttatcttgtgccttgagaaattgctggggagagaggtatgtccactgggcagctgtacaggatggaggatatagggcgtttccactcccagcagccaggttccctcaccccaagctcacccactgttggggagattatctacaataacaccagaaacacattggggtggattgggggtatccttatgggttcttttcagggaaccattgctggacaaggcacaggagccacctccatttctgagctctgcaagggacaagaactagagccatcaggggctgggctcactgtggccccaccccaagccgtcagcctccagggatctacaccctgccttggctgctacagctttttcactccactgccctaggggagttcagcaacctaatgatctctatctctgaacatctcttcatcccatgctccaagtccagcaacctgcaccctggaaccaggagtggaccctacccgagctgtctgtattaatccccatcccccaccaccaatcttaaaaagccctctgtccccctaccctaaaccccagttaggtacccatgctgggcaggtcagttaacaatttatgcacaggtactagttttattgtattaccgttccagggtagctttgaaaaaagtatctcaaaaaggcaacaccaccgcgcccagccaaattaaattttttatagagatgaggtcatgctgttatgttgcccaggttggcctcatgagatcttgccttagcctcccaaagtgctgggattacagatgtgagacactgcacccaaaccccaccacttttttttttcctttttctttttttgagacagtcttactccgttgcccaggctggagtgtagtggcatgatctcagctcactgcaacctccgcctcccgggttcaagcaattctcctgcctcagcctcccgagtagctgggattacagaggcctgccaccacacccgactaattttcgtatttttagtagagacggggtttctccatgttggccaggctgttcttgaactcctgacctcaagtgctccacctgcgttggcttcccaaagtgctgggatacaggagtgagccactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaggccgaggtgggaggatcccttgaagccaggagtttgagacaagcctgggcaacaaagcaagaccctatctctaaaaaaaaaaaaaaaaaaaaatctaggagatgctctttaccctgcctggcctcaaactattaatagcttcctttgagcaacattatttattatgaactttcaaacacaaaaaagtagagagagtagaataacaaatccccatgagcccatcacccaacttcagtaattatcaattcatggccatcttgttcacccctgcctgcttccctgcttcccctcattctgcagaggttcttttcttttgagacagagtgttgctctgttgcccaggctggagtgcagtggtgcaacttcggctcactgcaacctccgcctcccaggttcaagtgattctcctgcttcagcctctcaagtagctgggattacagatgcccgccaccacacctggctaattttcgtatttttgttagagatggggtttcaccatgttggccaggctggtctcgaactcctgacctcaagtgatccgcccgccttggcctcccaaaatgctgggattacaggtgtgaaccacggtgcctggccactgtacaggttatttatagaagttggagagtgaagggttgagaaagccaaggggcagatgcgggtctggaggattttgtgcctaaggccctctctttgctcccagacagcatgaagtaacaatgaggcatccacctcttggttttgtggcctctgtggatgacgtctctcaccttgaaccagttcagagttggagtagcgcaggatcctgtcttcagaggaggggccgaagcgggttcctctgttgtcaagctctttggaggtgcctggctgctactactgtcccagagaggtgatgatgaatgatgggtgtgtccagtggcagtttgccccactgaggcaggggcttccactaggccctgacagagcccttccagcaggcagaaatccctgtgctaggcaagattcaaactccgtagcatgtctcctgctcccatctcttaggaatggagtccttcaggccttgagtcccacattttccatgatgctccattaagcagctgatagcacccccacctccagggaaagtgagttcagagtccttggtctaatgcatctgtgttgaaattgaggccttcccctgtgttcacctttctgctctttttcttttagcccaaggctatgaaggcctcattcggtgctgggcatggtcactcctagcattcctcactctgttgctaacagcaacagcaataataataagggttacaacttactccataccttactgtctgccaggcattaagctaagtgctttacatatattaagtcatttaatcctcataatgaccctatgaaagagataccatctcaacccaattgacagctggtttgcaagattaggagggatgaaggacccaggggacaatgcgagggaaaactctgaccccggggccccaggctggatgttctttatgcctgtgaaccacagcttatcacatgtctggagttagggaccccacttaaagtgagattttggctggaggtggtggatcatacctataatcccagcactttgggagaccaaggcagaaggactgcttgaggccaggagttcaaaaccagtgtaggtaacagctagaccctatctctacaaaaaatttaaaaattagctgggtgtggtggtatgtgcctcaagttccagctactcaggaggctgaggtgggaggatcacttgagcacaggagtttgaagttacagtgagctatgatggcaccactgcacttcagcctaggcaacagagggagaccctgtctttaaagtacatagaggtttttcacaccaacacatctctgcccagtgtgccaacatctgccacctgctataatagtactataacactcaatatgtaattaatgtagtctcagggatgttatgacaatatgattacaactatcacgtgtgtgcccagccaggctcaatgccccaggctgggcgaggtggggcaggggacacagcctaaaatgccaggcctcaggaagccatttggtttagcagacattgtttattaaaggagttacctatgccagatcgaaggcctaagatgattaagacactatgagtgccttcaagtggttggggacgttcatgattgtggtacagacaaataggctttcacatcattcttttatgtaatcatacaacagatatttgcacctacatgtgcagagcactgtgataggcctcagtgacacagaataatacggcaaagaccccacccgatgagccccctcccaccacccaccagtacagtagggggtggtttaatggagtgttcctggaatatgaagtgggggcaggcattaggggtggcaaagggacaagtgtttatctgatcagttatgtactgtttataataagtaaatcagcagagggggaataatacttagaacctatagagagtaaatctgacaagatgaaatgctgatgaaaatatggaggaaatgaaactctcatgggttttgcagggaatctaagtcagtgctgtgttgtgaatgtaggtgtaccctttgaattcatatgttgaatcctaacccccaaagcaatggcattaagaggtggggcctttggggctgggtatggtggctcatgactgtaatcccagcactttgggatgctggcagggggcagatcacttgaagccaggagtctgagatcagcctggccaacatggtgaaaccccatctgtactaaaaatacaaaaattagccaggtgtgatggcgtacatctgtaatttcagccactcgggaggctgagacaggagaatagcttgaacccagtaggtggagatttcagtgagccgagatcgtgccactgcactccagcctgggtgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggttatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctgcaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagatagaataacaaatccccatgactccatctacccatctggaccactat

SEQ ID NO: 437632 - DNA, 7793 bp, Homo sapiens
gcgggaagggtcctgggccccgggcggcggtcgccaggtctcagggccgggggtacccgagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtatacctggcccctctccgaagccccttgtccctttcttggggattgtggaggctgggtcagaggggagttaagggactgcaggcctggcagcaggacatgccttggctgaaccaagtcctgagagcagcatctctgtccccacggtgccttgtgtgggtccccgtccttggctttctgggtcctgggctgcccccagtgctccagaccttccccactggcaatccaggttatcatccatgtcctccagaggagcttcctcctccaggcctcagccctgttggcccaggtggagcaggagggaccactggaacatgtggtgcttgggaatgcctctcctgttgcattggtccctgaaggcctcagggcaggtatgtggtgtgtgggcgactccacaagacctgcctcccatcctggcagcccagcctgagaccgttgcattgaggcaggcaggagcggcagggtggctgctctccaggagcccaactgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtagagctgagggcatgagaggcagagtgcacagtggtcaagggtgcagctctgcagcacaggcagcctaggcctgcgtcccaacctgcctctcaccagctctgtgaccttgggcaagggatttatctgtctgtcccttagttttctcacctgtaaaaggaggataagtatatatatatatttcccagtgttgtgaagattaaaggagtttatcgatgtaggtcttaggatgagtcctggcatttaccaagggttggatatatgttattatcactattaagtgttgagggtccaggcatgctgggcaacagggaccccatctctacaaaaaagtttaaaaaattagccaggcgtggtggtgcacctgtcgtcttagctacttgggaggctgaggtgggaggatcacttgagcccagaagcttgaagctgcagtgagctaggatcgtgccactgcactccaacctgggtgagagagcgagaccctgtctcaagaaaaagaaaaatgcagagaaacaggagtcttggctactcctttagaggcagactcagaccctcctgcctcacagctttatctttgtatttgccccttactttatcttgtgccttgagaaattgctggggagagaggtatgtccactgggcagctgtacaggatggaggatatagggcgtttccactcccagcagccaggttccctcaccccaagctcacccactgttggggagattatctacaataacaccagaaacacattggggtggattgggggtatccttatgggttcttttcagggaaccattgctggacaaggcacaggagccacctccatttctgagctctgcaagggacaagaactagagccatcaggggctgggctcactgtggccccaccccaagccgtcagcctccagggatctacaccctgccttggctgctacagctttttcactccactgccctaggggagttcagcaacctaatgatctctatctctgaacatctcttcatcccatgctccaagtccagcaacctgcaccctggaaccaggagtggaccctacccgagctgtctgtattaatccccatcccccaccaccaatcttaaaaagccctctgtccccctaccctaaaccccagttaggtacccatgctgggcaggtcagttaacaatttatgcacaggtactagttttattgtattaccgttccagggtagctttgaaaaaagtatctcaaaaaggcaacaccaccgcgcccagccaaattaaattttttatagagatgaggtcatgctgttatgttgcccaggttggcctcatgagatcttgccttagcctcccaaagtgctgggattacagatgtgagacactgcacccaaaccccaccacttttttttttcctttttctttttttgagacagtcttactccgttgcccaggctggagtgtagtggcatgatctcagctcactgcaacctccgcctcccgggttcaagcaattctcctgcctcagcctcccgagtagctgggattacagaggcctgccaccacacccgactaattttcgtatttttagtagagacggggtttctccatgttggccaggctgttcttgaactcctgacctcaagtgctccacctgcgttggcttcccaaagtgctgggatacaggagtgagccactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaggccgaggtgggaggatcccttgaagccaggagtttgagacaagcctgggcaacaaagcaagaccctatctctaaaaaaaaaaaaaaaaaaaaatctaggagatgctctttaccctgcctggcctcaaactattaatagcttcctttgagcaacattatttattatgaactttcaaacacaaaaaagtagagagagtagaataacaaatccccatgagcccatcacccaacttcagtaattatcaattcatggccatcttgttcacccctgcctgcttccctgcttcccctcattctgcagaggttcttttcttttgagacagagtgttgctctgttgcccaggctggagtgcagtggtgcaacttcggctcactgcaacctccgcctcccaggttcaagtgattctcctgcttcagcctctcaagtagctgggattacagatgcccgccaccacacctggctaattttcgtatttttgttagagatggggtttcaccatgttggccaggctggtctcgaactcctgacctcaagtgatccgcccgccttggcctcccaaaatgctgggattacaggtgtgaaccacggtgcctggccactgtacaggttatttatagaagttggagagtgaagggttgagaaagccaaggggcagatgcgggtctggaggattttgtgcctaaggccctctctttgctcccagacagcatgaagtaacaatgaggcatccacctcttggttttgtggcctctgtggatgacgtctctcaccttgaaccagttcagagttggagtagcgcaggatcctgtcttcagaggaggggccgaagcgggttcctctgttgtcaagctctttggaggtgcctggctgctactactgtcccagagaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggttatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctgcaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagatagaataacaaatccccatgactccatctacccatctggaccactat

SEQ ID NO: 437633 - DNA, 7652 bp, Homo sapiens
gcgggaagggtcctgggccccgggcggcggtcgccaggtctcagggccgggggtacccgagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtatacctggcccctctccgaagccccttgtccctttcttggggattgtggaggctgggtcagaggggagttaagggactgcaggcctggcagcaggacatgccttggctgaaccaagtcctgagagcagcatctctgtccccacggtgccttgtgtgggtccccgtccttggctttctgggtcctgggctgcccccagtgctccagaccttccccactggcaatccaggttatcatccatgtcctccagaggagcttcctcctccaggcctcagccctgttggcccaggtggagcaggagggaccactggaacatgtggtgcttgggaatgcctctcctgttgcattggtccctgaaggcctcagggcaggtatgtggtgtgtgggcgactccacaagacctgcctcccatcctggcagcccagcctgagaccgttgcattgaggcaggcaggagcggcagggtggctgctctccaggagcccaactgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtagagctgagggcatgagaggcagagtgcacagtggtcaagggtgcagctctgcagcacaggcagcctaggcctgcgtcccaacctgcctctcaccagctctgtgaccttgggcaagggatttatctgtctgtcccttagttttctcacctgtaaaaggaggataagtatatatatatatttcccagtgttgtgaagattaaaggagtttatcgatgtaggtcttaggatgagtcctggcatttaccaagggttggatatatgttattatcactattaagtgttgagggtccaggcatgctgggcaacagggaccccatctctacaaaaaagtttaaaaaattagccaggcgtggtggtgcacctgtcgtcttagctacttgggaggctgaggtgggaggatcacttgagcccagaagcttgaagctgcagtgagctaggatcgtgccactgcactccaacctgggtgagagagcgagaccctgtctcaagaaaaagaaaaatgcagagaaacaggagtcttggctactcctttagaggcagactcagaccctcctgcctcacagctttatctttgtatttgccccttactttatcttgtgccttgagaaattgctggggagagaggtatgtccactgggcagctgtacaggatggaggatatagggcgtttccactcccagcagccaggttccctcaccccaagctcacccactgttggggagattatctacaataacaccagaaacacattggggtggattgggggtatccttatgggttcttttcagggaaccattgctggacaaggcacaggagccacctccatttctgagctctgcaagggacaagaactagagccatcaggggctgggctcactgtggccccaccccaagccgtcagcctccagggatctacaccctgccttggctgctacagctttttcactccactgccctaggggagttcagcaacctaatgatctctatctctgaacatctcttcatcccatgctccaagtccagcaacctgcaccctggaaccaggagtggaccctacccgagctgtctgtattaatccccatcccccaccaccaatcttaaaaagccctctgtccccctaccctaaaccccagttaggtacccatgctgggcaggtcagttaacaatttatgcacaggtactagttttattgtattaccgttccagggtagctttgaaaaaagtatctcaaaaaggcaacaccaccgcgcccagccaaattaaattttttatagagatgaggtcatgctgttatgttgcccaggttggcctcatgagatcttgccttagcctcccaaagtgctgggattacagatgtgagacactgcacccaaaccccaccacttttttttttcctttttctttttttgagacagtcttactccgttgcccaggctggagtgtagtggcatgatctcagctcactgcaacctccgcctcccgggttcaagcaattctcctgcctcagcctcccgagtagctgggattacagaggcctgccaccacacccgactaattttcgtatttttagtagagacggggtttctccatgttggccaggctgttcttgaactcctgacctcaagtgctccacctgcgttggcttcccaaagtgctgggatacaggagtgagccactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaggccgaggtgggaggatcccttgaagccaggagtttgagacaagcctgggcaacaaagcaagaccctatctctaaaaaaaaaaaaaaaaaaaaatctaggagatgctctttaccctgcctggcctcaaactattaatagcttcctttgagcaacattatttattatgaactttcaaacacaaaaaagtagagagagtagaataacaaatccccatgagcccatcacccaacttcagtaattatcaattcatggccatcttgttcacccctgcctgcttccctgcttcccctcattctgcagaggttcttttcttttgagacagagtgttgctctgttgcccaggctggagtgcagtggtgcaacttcggctcactgcaacctccgcctcccaggttcaagtgattctcctgcttcagcctctcaagtagctgggattacagatgcccgccaccacacctggctaattttcgtatttttgttagagatggggtttcaccatgttggccaggctggtctcgaactcctgacctcaagtgatccgcccgccttggcctcccaaaatgctgggattacaggtgtgaaccacggtgcctggccactgtacaggttatttatagaagttggagagtgaagggttgagaaagccaaggggcagatgcgggtctggaggattttgtgcctaaggccctctctttgctcccagacagcatgaagtaacaatgaggcatccacctcttggttttgtggcctctgtggatgacgtctctcaccttgaaccagttcagagttggagtagcgcaggatcctgtcttcagaggaggggccgaagcgggttcctctgttgtcaagctctttggaggtgcctggctgctactactgtcccagagaggtgatgatgaatgatgggtgtgtccagtggcagtttgccccactgaggcaggggcttccactaggccctgacagagcccttccagcaggcagaaatccctgtgctaggcaagattcaaactccgtagcatgtctcctgctcccatctcttaggaatggagtccttcaggccttgagtcccacattttccatgatgctccattaagcagctgatagcacccccacctccagggaaagtgagttcagagtccttggtctaatgcatctgtgttgaaattgaggccttcccctgtgttcacctttctgctctttttcttttagcccaaggctatgaaggcctcattcggtgctgggcatggtcactcctagcattcctcactctgttgctaacagcaacagcaataataataagggttacaacttactccataccttactgtctgccaggcattaagctaagtgctttacatatattaagtcatttaatcctcataatgaccctatgaaagagataccatctcaacccaattgacagctggtttgcaagattaggagggatgaaggacccaggggacaatgcgagggaaaactctgaccccggggccccaggctggatgttctttatgcctgtgaaccacagcttatcacatgtctggagttagggaccccacttaaagtgagattttggctggaggtggtggatcatacctataatcccagcactttgggaagaagctggcagccactaagttcagactgttctgggtccgattgctgctgaggctgtggtttggcttccttggcttcccaggctggttatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctgcaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagatagaataacaaatccccatgactccatctacccatctggaccactat
